United States Patent 12,152,077 (IMMUNOTHERAPY TARGETING TUMOR NEOANTIGENIC PEPTIDES) - sequence listing, part 3

SEQ ID NO: 4397 - DNA, 1767 bp, synthetic construct
  misc_feature 1..1767: note = Synthetic polypeptide
  source 1..1767: mol_type = other DNA
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgggg

SEQ ID NO: 4398 - DNA, 661 bp, synthetic construct
  misc_feature 1..661: note = Synthetic polypeptide
  source 1..661: mol_type = other DNA
atggcggcggtggtagctgctacggcgctgaagggccggggggcgagaaatgcccgcgtcctccgggggattctcgcaggagccacagctaacaaggcttctcataacaggacccgggccctgcaaagccacagctccccagagggcaaggaggaacctgaacccctatccccggagctggaatacattcccagaaagaggggcaagaaccccatgaaagctgtgggactggcctggtacagcctgtacacccgcacctggctcgggtacctcttctaccgacagcagctgcgcagggctcggaatcgctaccctaaaggccactcgaaaacccagccccgcctcttcaatggagtgaaggtgcttcccatccctgtcctctcggacaactacagctacctcatcatcgacacccaggcccagctggctgtggctgtggacccttcagaccctcgggctgtgcaggctacctctgcactttgtcaatgcttctcttgtggcacttatcacactgtattttacttgtttacatgtttgtctccccttctagactgtgaatccttaagggcatggactgtatcttatgcatctctgtatttctgcgcctagcacggtgcctagcacacagtaggcgctcaataaatgttgaatgaatgaatga

SEQ ID NO: 4399 - DNA, 589 bp, synthetic construct
  misc_feature 1..589: note = Synthetic polypeptide
  source 1..589: mol_type = other DNA
atggcttggcagggctggcccgcggcgtggcagtgggtcgccggctgctggctcctcctcgtccttgtcctcgtcctacttgtgagcccccgcggctgccgagcgcggcggggcctccgcggtctgctcatggcgcacagccagcggctgctcttccgaatcgggtacagcctgtacacccgcacctggctcgggtacctcttctaccgacagcagctgcgcagggctcggaatcgctaccctaaaggccactcgaaaacccagccccgcctcttcaatggagtgaaggtgcttcccatccctgtcctctcggacaactacagctacctcatcatcgacacccaggcccagctggctgtggctgtggacccttcagaccctcgggctgtgcaggctacctctgcactttgtcaatgcttctcttgtggcacttatcacactgtattttacttgtttacatgtttgtctccccttctagactgtgaatccttaagggcatggactgtatcttatgcatctctgtatttctgcgcctagcacggtgcctagcacacagtaggcgctcaataaatgttgaatgaatgaatga

SEQ ID NO: 4400 - DNA, 481 bp, synthetic construct
  misc_feature 1..481: note = Synthetic polypeptide
  source 1..481: mol_type = other DNA
atgccctcctcagtgcatcataccaagaggcaaatgatgtctatatattgttactggtacagcctgtacacccgcacctggctcgggtacctcttctaccgacagcagctgcgcagggctcggaatcgctaccctaaaggccactcgaaaacccagccccgcctcttcaatggagtgaaggtgcttcccatccctgtcctctcggacaactacagctacctcatcatcgacacccaggcccagctggctgtggctgtggacccttcagaccctcgggctgtgcaggctacctctgcactttgtcaatgcttctcttgtggcacttatcacactgtattttacttgtttacatgtttgtctccccttctagactgtgaatccttaagggcatggactgtatcttatgcatctctgtatttctgcgcctagcacggtgcctagcacacagtaggcgctcaataaatgttgaatgaatgaatga

SEQ ID NO: 4401 - DNA, 926 bp, synthetic construct
  misc_feature 1..926: note = Synthetic polypeptide
  source 1..926: mol_type = other DNA
atgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagccgggcgcggtggctcacgcctgtaatcccagcactttgggaggctgaggcgggtggatcacctgaggtcacgagttcagaaccagcctaaccaacatggcgaaaccctgtctctactaaaaactacaaaaatgagccaggcctggtggtttgtgcctatagtcccagctacttgggaggctgaggcaggagagttgcttggacccgggaggtggaggttgcagtgagctgagattgtgccactgcactccagcctgggtgacagaatgagactctgtgtcaaaaaaaaaaaaaaa

SEQ ID NO: 4402 - DNA, 1606 bp, synthetic construct; identical to SEQ ID NO: 327
  misc_feature 1..1606: note = Synthetic polypeptide
  source 1..1606: mol_type = other DNA

SEQ ID NO: 4403 - DNA, 175 bp, synthetic construct; identical to SEQ ID NO: 329
  misc_feature 1..175: note = Synthetic polypeptide
  source 1..175: mol_type = other DNA

SEQ ID NO: 4404 - DNA, 690 bp, synthetic construct; identical to SEQ ID NO: 145
  misc_feature 1..690: note = Synthetic polypeptide
  source 1..690: mol_type = other DNA

SEQ ID NO: 4405 - DNA, 1216 bp, synthetic construct; identical to SEQ ID NO: 1380
  misc_feature 1..1216: note = Synthetic polypeptide
  source 1..1216: mol_type = other DNA

SEQ ID NO: 4406 - DNA, 1155 bp, synthetic construct
  misc_feature 1..1155: note = Synthetic polypeptide
  source 1..1155: mol_type = other DNA
atggtagatggaaccctccttttactcctctcggaggccctggcccttacccagacctgggcgggctcccactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctactacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattct

SEQ ID NO: 4407 - DNA, 868 bp, synthetic construct
  misc_feature 1..868: note = Synthetic polypeptide
  source 1..868: mol_type = other DNA
atggtagatggaaccctccttttactcctctcggaggccctggcccttacccagacctgggcgggctcccactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctactacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattct

SEQ ID NO: 4408 - DNA, 7772 bp, synthetic construct
  misc_feature 1..7772: note = Synthetic polypeptide
  source 1..7772: mol_type = other DNA
atgtacaacgggatcgggctgccgacgccccggggcagcggcaccaacggctacgtccagcgcaacctgtccctggtgcggggccgccggggtgagcggcctgactacaagggagaggaggaactgcggcgcctggaggctgccctggtgaagcggcctaatcctgacatcctggaccacgagcgcaagcggcgcgtcgagctgcgatgcctcgagctggaggagatgatggaagagcaggggtacgaggaacagcaaattcaggaaaaagtggcgacctttcgactcatgttgctggagaaggatgtgaaccctgggggcaaggaggagaccccagggcagaggccagcggtcacggagactcaccagttggcagaattaaatgagaagaagaatgaaagactccgtgctgcctttggcatcagtgattcttacgtagatggcagctcttttgatcctcagcgtcgtgcccgagaagctaaacaaccagctcctgagcctcccaaaccttacagccttgttcgggagtctagcagttctcgctcaccaaccccaaagcagaagaagaagaaaaagaagaaagatagaggacgcaggtcagagagcagctctcctcgacgggagagaaagaaaagctcaaagaagaagaagcacaggtcagaatctgagtccaagaaacgtaagcataggtctcccactccaaagagcaaacgtaaatctaaggacaaaaagcgaaagcggtctcgaagtacaacaccagcccccaagagccgccgggcccaccgttcaacttctgctgactctgcttcctcctccgatacttcccgcagtcggtctcgaagtgctgcagctaaaactcatacaactgccttggctgggcgaagtccttcccctgcttcagggcgacgcggggagggagatgcgcctttcagtgaaccaggtactaccagcacacaacggcctagtagcccggagactgctacgaaacagcctagcagcccttatgaagacaaagataaagacaagaaggagaaatctgcaactcgacctagcccctctccggaaaggagcagcacaggcccagaaccacctgctcccactccgctccttgctgagcgacatggcggctccccacaaccccttgcaaccacccccttaagccaggagccagtgaaccccccatctgaggcctctccaactcgggaccgttcaccacctaagtctcccgagaaacttccccagtcttcttcctcagagagcagcccaccatcccctcaacctaccaaagtttctcggcatgccagctcttccccagaaagtcctaaacctgctccagctccagggtcccaccgagagatttcttcttctcccacatctaagaatcgctcacatggccgagcaaaacgggataaatcacattctcataccccctcccgtaggatggggaggtcccgtagccctgccaccgctaagagagggcgatctcggtctcgaacccctaccaagagaggtcattctcgatcccgatctccccagtggcgtaggtccaggtctgcacagaggtggggaagatctagaagcccccagcgacgtggccgctctaggtctcctcagcgaccaggctggtctaggagcagaaatacccagagaagaggcaggtctaggtcagcaaggcgagggaggtcccactctagatccccagccactaggggtagatctcgttctagaacaccagcccgccggggcaggtcccgctctagaacacctgccaggcggagatcacgatccagaactcccaccaggcgtaggtctcggtctagaacaccagcccggaggggcaggtctcggtctagaacacctgctaggcgcagatctaggacccgatcaccagtacgacgcaggtctcgtagtagatcaccagccaggagaagtggcaggtcacgctctagaaccccagctagacgtggccgctcacgctccagaaccccagccagacgtggccgctcacgctctagaaccccagctagacgcagtggtcgctcacgctccagaacaccagccaggagagggaggtctcggtctaggacaccaagacgaggaagatcccgcagtagaagcttagttagacgtggaagatctcactctagaacacctcaaagaagaggcagatctggctcatcttcagagcggaaaaacaaatccagaacatctcaaagaagaagcaggtccaattcaagcccagaaatgaagaaatctcgcatttcttcaaggcggagcaggtctctctcttcaccacggtccaaagcaaaatctcgcttgtctttgaggcgcagcctttcagggtcttccccatgccctaaacaaaagtcacagacaccacccaggcgcagtcgctctggatcctcccaacctaaagctaaatctagaacgccacccagacgcagtcgctccagttcttctccgccacctaaacagaaatctaagacaccatcaagacaaagtcattccagttcatctcctcatcctaaagtgaaatctggaacaccaccgaggcaagggtccataacaagtccccaggccaatgagcaatctgtaacgccacagagacggagctgttttgaatcatcacctgaccctgagttgaaatctaggaccccttctagacatagctgctcagggtcctctcctcctagagtgaaatctagcacacctcccagacagagcccatctaggtcatcatctccacaacccaaagtgaaggcaataatatcaccaagacaaagaagccattctggctcctcttctccaagtcctagtagggtgacgtcgagaacaactccacggcgaagcagatcagtatctccctgctccaatgtggaatccagattgttgccaagatacagtcattctgggtcctcctcaccagataccaaagtgaaacctgaaacaccgccaagacaaagtcactcagggtctatttcaccataccccaaagtaaaggcccaaactccaccggggccaagtctttctggatcaaagtcaccatgtccccaagagaagtctaaagactcactagttcaaagttgccctggatccctctctctctgtgcaggagtaaaatctagcacaccaccaggcgagagctattttggtgtctcatctctgcaactgaaaggacaatctcaaacttcaccagaccacagatctgatacttcaagtccagaagtgagacagagtcattcagaatcaccatctctgcagagcaaatctcaaacatcacctaagggaggtcggtccaggtcttcatctccagtcactgagctggcatccagatctccaataagacaagatagaggtgagttctcagcgagtcctatgttgaaatctggaatgtctcctgagcagagcaggttccagtctgactcttcttcatatcctacagtggactcgaattctctcttggggcagagtagattggagactgctgaatcaaaagagaaaatggccttaccccctcaggaggatgctactgcatcacctcctagacagaaagacaaatttagtccctttccagtacaggataggcctgagtcttcactggtattcaaagacacacttagaaccccgccaagggaaagaagtggtgctgggtcatctccagaaacaaaagagcaaaatagtgcattgcctacgtcaagccaagatgaagagttaatggaggtggtagagaagtctgaagaacccgcaggccaaatcctgtctcatttgtcttcagaacttaaagaaatgtccacaagtaactttgaatcatctcctgaagtagaagaaaggcctgctgtgtctttgactcttgatcagagccagtcacaggcttctttggaagcagtagaagtcccttcaatggcctcatcttggggtgggccacatttttctccagaacataaagaactgtctaactccccactcagggagaacagctttggatcacctttagaatttagaaactcaggcccacttggtacagaaatgaatactggattttcttctgaggttaaagaagatttgaatggaccgtttcttaatcagctggaaacagatccatctctagacatgaaagaacaatcgacaagatcctctggacacagcagttctgagttatccccagatgcagtggaaaaggcagggatgtcttcaaatcagagcatctcttcacctgtgcttgatgctgtacccagaacaccctcgagagaaagaagtagttctgcatcttctcctgaaatgaaagatggtttacccagaactccatcaaggagaagcaggtctgggtcttctccaggacttagagatgggtctgggactccctcgaggcacagcctgtctgggtcctctcctggaatgaaagatatacctagaacgccatctagagggagaagcgaatgtgattcttccccagaaccgaaagctttgcctcagactcctaggccgaggagtcgttctccatcatccccagagctcaacaacaagtgtcttaccccccagagagaaagaagcgggtcagaatcatcagttgatcagaaaactgtggctcggactcccctggggcagagaagtcgttcgggatcctctcaagaacttgatgtgaaacccagtgcatcccctcaggaaagaagtgagtcagactcttctccagattctaaagccaagacaagaaccccacttcggcagaggagtcggtctggatcatctccagaggttgacagcaaatctcgactatcccctcggcgcagtaggtctggttcctcccctgaagtgaaagataagccaagagcagcacccagggcacagagtggttctgattcctctcctgaacctaaagctccagcccctcgggcccttcccagacgaagcagatcaggttcatcaagcaaaggcagaggcccttctcctgaaggaagcagcagtaccgagtcctctcctgaacatccgcccaaatccagaactgctcgcagaggttccaggtcatcaccagagcccaagaccaagtctcgtacaccacctcgacgtcgcagctctcgatcatctccggagctaacaaggaaggccagactgtcccgtagaagccgctctgcctcatcctcaccagaaactcgctctagaactcccccaaggcaccggagaagtccctcagtgtcttccccggagccagccgaaaaatcgaggtcttcacgccgacggcgctcagcttcatctccacgcactaagacaacctcaaggagaggccgctctccttcgccaaagcctcgtggactccagaggtcccgttcccgctcaaggagagagaaaacaagaacaacccgacgtcgagataggtctggatcttctcagtcaacctctcggcgaagacagcggagccggtcaaggtcgcgggttactcggcggcggaggggaggctctggttatcactcaaggtcacctgcccggcaggaaagttcccggacctcctctcgacgccgaagaggccgctctcggacacccccaaccagtcggaagcgttctcgctcacgcacatcaccagccccgtggaaacgctctagatctcgagcctctccagccactcaccggcgatccaggtccagaacccccctgataagccgacgtaggtccagatctcgaacttcaccagtcagccggagacggtcaaggtccaggacttcagtgactcgacgaagatcccggtcaagagcatccccagtgagcagaaggcgatccagatccagaacgccaccagtaacccgccgtcgttcaaggtctagaacgccaacaacacgccgccgctcccgttctagaactccaccagtgactcgcagaaggtccagatccaggactccaccagtaaccaggaggcgatctcgaagcagaacttcgcctatcactcgcagaagatcaagatccagaacatctccggtcacccgaaggagatctcgatctcgcacatctccagtaactcgaagaaggtcccgctctcgaacctcaccagtgacacgccgccgctctaggtcccggacacctccagctattcggcgccgctctagatctcgaacgccactgttaccacgcaaacgttctcgaagtcgctcaccacttgctatccgccgccgctccagatcccgtactccacgaacagctcggggtaaacggtccttaacaagatctcctccagccatccgcaggcgttctgcatctggaagtagttctgatcgttcacgatctgctactcctccagcaacaagaaatcattctggttcacggacacctccagtagcactcaacagttccagaatgagctgcttcagtcgtcctagcatgtccccaacacctcttgatcgctgcagatcacctggaatgcttgaaccccttggcagctctagaacacccatgtctgtcctgcagcaagccggcggctccatgatggatggtccaggtccccgaatacctgaccaccagagaacatctgtgccagaaaatcatgctcagtccaggattgcacttgccctgacagctatcagtcttggcaccgctcggcctcctccgtccatgtctgctgctggccttgctgcaagaatgtcccaggttccagccccggtgcctctcatgagtctcagaaccgcaccagcagccaaccttgccagcaggattcctgcagcctctgcggcagccatgaacctagccagcgccaggacacctgccattccaacagcagtgaacctggctgactctcgaacgccagctgcagcagcggccatgaacttggccagccccagaacagcggtggcaccttcggctgtgaacctggctgaccctcgcactcccacagccccagctgtgaacctagcaggggccagaaccccagctgccttggcagctctgagtctcacaggctctggcacaccaccaactgctgcaaactatccctccagctccagaacaccacaggctccagcctctgcaaacctggtgggtcctcggtctgcacatgccacagctcctgtgaatattgccggctccagaaccgccgcagccttggcccccgcgagcctcaccagtgctaggatggctccagcattgtctggtgcaaacctcaccagccccagggtgcccctttctgcctacgagcgtgtcagtggcagaacctcaccaccgctccttgaccgagctaggtccagaacaccaccgtctgccccaagccaatctaggatgacctctgaacgggctccctccccttcctctagaatgggccaggctccttcacagtctcttctccctccagcacaggatcagccgaggtctcctgtgccttctgctttttcagaccaatcccgttgtttgattgcccagaccacccctgtagcagggtctcagtccctttcctctggggcagtggcaacgaccacgtcctctgctggtgatcacaatggcatgctctctgtccctgcccctggggtgccccactctgatgtgggggagccacctgcctctactggggcccagcagccttctgcattagccgccctgcagccagcaaaggagcggcggagttcctcctcgtcgtcgtcgtcctctagctcctcctcttcttcatcatcgtcgtcgtcgtcctcctcctcctctggctccagttctagtgactcagagggctctagccttcctgtgcaacctgaggtggcactgaagagcaggagggatggcagttagacctcaagaggaactccctg

SEQ ID NO: 4409 - DNA, 579 bp, synthetic construct
  misc_feature 1..579: note = Synthetic polypeptide
  source 1..579: mol_type = other DNA
accaccgctccttgaccgagctaggtccagaacaccaccgtctgccccaagccaatctaggatgacctctgaacgggctccctccccttcctctagaatgggccaggctccttcacagtctcttctccctccagcacaggatcagccgaggtctcctgtgccttctgctttttcagaccaatcccgttgtttgattgcccagaccacccctgtagcagggtctcagtccctttcctctggggcagtggcaacgaccacgtcctctgctggtgatcacaatggcatgctctctgtccctgcccctggggtgccccactctgatgtgggggagccacctgcctctactggggcccagcagccttctgcattagccgccctgcagccagcaaaggagcggcggagttcctcctcgtcgtcgtcgtcctctagctcctcctcttcttcatcatcgtcgtcgtcgtcctcctcctcctctggctccagttctagtgactcagagggctctagccttcctgtgcaacctgaggtggcactgaagagcaggagggatggcagttagacctcaagaggaactccctg

SEQ ID NO: 4410 - DNA, 1307 bp, synthetic construct; identical to SEQ ID NO: 1904
  misc_feature 1..1307: note = Synthetic polypeptide
  source 1..1307: mol_type = other DNA

SEQ ID NO: 4411 - DNA, 1421 bp, synthetic construct; identical to SEQ ID NO: 1905
  misc_feature 1..1421: note = Synthetic polypeptide
  source 1..1421: mol_type = other DNA

SEQ ID NO: 4412 - DNA, 1325 bp, synthetic construct; identical to SEQ ID NO: 1906
  misc_feature 1..1325: note = Synthetic polypeptide
  source 1..1325: mol_type = other DNA

SEQ ID NO: 4413 - DNA, 1403 bp, synthetic construct; identical to SEQ ID NO: 1907
  misc_feature 1..1403: note = Synthetic polypeptide
  source 1..1403: mol_type = other DNA

SEQ ID NO: 4414 - DNA, 539 bp, synthetic construct; identical to SEQ ID NO: 1908
  misc_feature 1..539: note = Synthetic polypeptide
  source 1..539: mol_type = other DNA

SEQ ID NO: 4415 - DNA, 1262 bp, synthetic construct; identical to SEQ ID NO: 1909
  misc_feature 1..1262: note = Synthetic polypeptide
  source 1..1262: mol_type = other DNA

SEQ ID NO: 4416 - DNA, 832 bp, synthetic construct
  misc_feature 1..832: note = Synthetic polypeptide
  source 1..832: mol_type = other DNA
atggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggtcccaagccctgcttccctgtggcctccaccgccatctccagccccttcttctaccaagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggaggaggatcatttatgcttgggaggtcgaggctgcagtgagtcatgattgtatgactgcactccagcctgggtgacagagcaagaccctgtttcaaaaagaaaaa

SEQ ID NO: 4417 - DNA, 910 bp, synthetic construct
  misc_feature 1..910: note = Synthetic polypeptide
  source 1..910: mol_type = other DNA
atggccggggggccgggcccgggggagcccgcagcccccggcgcccagcacttcttgtacgaggtgccgccctgggtcatgtgccgcttctacaaagtgatggacgccctggagcccgccgactggtgccagttcggtgggtggcggcgggctgccggggggcgggaggcgcgcgggctcctggcgccgacgcctgacgccccccgccccgcagccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggtcccaagccctgcttccctgtggcctccaccgccatctccagccccttcttctaccaagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggaggaggatcatttatgcttgggaggtcgaggctgcagtgagtcatgattgtatgactgcactccagcctgggtgacagagcaagaccctgtttcaaaaagaaaaa

SEQ ID NO: 4418 - DNA, 143 bp, synthetic construct
  misc_feature 1..143: note = Synthetic polypeptide
  source 1..143: mol_type = other DNA
gatgaggaacacggtgtatgctgtgaagaggctgaaggaggaggatcatttatgcttgggaggtcgaggctgcagtgagtcatgattgtatgactgcactccagcctgggtgacagagcaagaccctgtttcaaaaagaaaaa

SEQ ID NO: 4419 - DNA, 288 bp, synthetic construct
  misc_feature 1..288: note = Synthetic polypeptide
  source 1..288: mol_type = other DNA
atggtcttgctgacttcaagaatgaagccgctgacctcgcgcataattagcatcatcattattctggctggagcaattgcactcatcattggctttggtatttcaggggtttctgcttttgcatctttctcattttctcttgccactgccatgtaagaagtgcctttcacctcccgccatgactctgaggcctccccagccatgtgaaactgttaagttcaattaaacctctttttcttccaagtctcgggtatttctttatcagcactgtgaaaatggactaataca

SEQ ID NO: 4420 - DNA, 279 bp, synthetic construct
  misc_feature 1..279: note = Synthetic polypeptide
  source 1..279: mol_type = other DNA
atggcttccctggggcagatcctcttctggagcataattagcatcatcattattctggctggagcaattgcactcatcattggctttggtatttcaggggtttctgcttttgcatctttctcattttctcttgccactgccatgtaagaagtgcctttcacctcccgccatgactctgaggcctccccagccatgtgaaactgttaagttcaattaaacctctttttcttccaagtctcgggtatttctttatcagcactgtgaaaatggactaataca

SEQ ID NO: 4421 - DNA, 719 bp, synthetic construct
  misc_feature 1..719: note = Synthetic polypeptide
  source 1..719: mol_type = other DNA
atggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctct

SEQ ID NO: 4422 - DNA, 596 bp, synthetic construct
  misc_feature 1..596: note = Synthetic polypeptide
  source 1..596: mol_type = other DNA
atgggggcgggggaacagaacaggcaaagtgcccactgtgtgcagggcatatgcgggtacctggagggagatgaagaaggggaagagggggaggtgcgaagcactcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctct

SEQ ID NO: 4423 - DNA, 1806 bp, synthetic construct
  misc_feature 1..1806: note = Synthetic polypeptide
  source 1..1806: mol_type = other DNA
atgaggtcctgcctgtggagatgcaggcacctgagccaaggcgtccagtggtccttgcttctggctgtcctggtcttctttctcttcgccttgccctcttttattaaggagcctcaaacaaagccttccaggcatcaacgcacagagaacattaaagaaaggtctctacagtccctggcaaagcctaagtcccaggcacccacaagggcaaggaggacaaccatctatgcagagccagtgccagagaacaatgccctcaacacacaaacccagcccaaggcccacaccaccggagacagaggaaaggaggccaaccaggcaccgccggaggagcaggacaaggtgccccacacagcacagagggcagcatggaagagcccagaaaaagagaaaaccatggtgaacacactgtcacccagagggcaagatgcagggatggcctctggcaggacagaggcacaatcatggaagagccaggacacaaagacgacccaaggaaatgggggccagaccaggaagctgacggcctccaggacggtgtcagagaagcaccagggcaaagcggcaaccacagccaagacgctcattcccaaaagtcagcacagaatgctggctcccacaggagcagtgtcaacaaggacgagacagaaaggagtgaccacagcagtcatcccacctaaggagaagaaacctcaggccaccccaccccctgcccctttccagagccccacgacgcagagaaaccaaagactgaaggccgccaacttcaaatctgagcctcggtgggattttgaggaaaaatacagcttcgaaataggaggccttcagacgacttgccctgactctgtgaagatcaaagcctccaagtcgctgtggctccagaaactctttctgcccaacctcactctcttcctggactccagacacttcaaccagagtgagtgggaccgcctggaacactttgcaccaccctttggcttcatggagctcaactactccttggtgcagaaggtcgtgacacgcttccctccagtgccccagcagcagctgctcctggccagcctccccgctgggagcctccggtgcatcacctgtgccgtggtgggcaacgggggcatcctgaacaactcccacatgggccaggagatagacagtcacgactacgtgttccgattgagcggagctctcattaaaggctacgaacaggatgtggggactcggacatccttctacggctttaccgccttctccctgacccagtcactccttatattgggcaatcggggtttcaagaacgtgcctcttgggaaggacgtccgctacttgcacttcctggaaggcacccgggactatgagtggctggaagcactgcttatgaatcagacggtgatgtcaaaaaaccttttctggttcaggcacagaccccaggaagcttttcgggaagccctgcacatggacaggtacctgttgctgcacccagactttctccgatacatgaagaacaggtttctgaggtctaagaccctggatggtgcccactggaggatataccgccccaccactggggccctcctgctgctcactgcccttcagctctgtgaccagaaagtaaggacgtgcttaaagaatggaacacatcaaaagaacacagaagccagcctgaagacgctcccactggctcaatacaagatgatttgagaatgaaaattggtaatgatggtaatgaatttcaacacattcaacaaatggtaatctaggagtccacactgatataaataaatacatacacacatacataagaaagaa

SEQ ID NO: 4424 - DNA, 1246 bp, synthetic construct
  misc_feature 1..1246: note = Synthetic polypeptide
  source 1..1246: mol_type = other DNA
atggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctct

SEQ ID NO: 4425 - DNA, 1123 bp, synthetic construct
  misc_feature 1..1123: note = Synthetic polypeptide
  source 1..1123: mol_type = other DNA
atgggggcgggggaacagaacaggcaaagtgcccactgtgtgcagggcatatgcgggtacctggagggagatgaagaaggggaagagggggaggtgcgaagcactcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctct

SEQ ID NO: 4426 - DNA, 384 bp, synthetic construct
  misc_feature 1..384: note = Synthetic polypeptide
  source 1..384: mol_type = other DNA
atgctagagaacctggctctcatatcctcgctggatcctgcactggatggatcagcggacaacacacagaccggtaatctgggtcaatcagttctgccatcccacccagaacagaaaacagcatgaaaaactcactttaaccccctatgaatccatctccaaccagactgatcagcactccccacttcccaagcccctacccgccaaattttgaaaactctgatcccagaatgctcagggagactgatttgaataataaaactcctgtctcccgaacagcaggacggctctgcgtgaattactatttctccatcgcaattccccagtcttcataaatcggctctgtctaggcagctggcaacgtgaacccactggacggttaca

SEQ ID NO: 4427 - DNA, 458 bp, synthetic construct
  misc_feature 1..458: note = Synthetic polypeptide
  source 1..458: mol_type = other DNA
atgtggctgtgaacttttcccaggaggagtggtgtcttcttagtgaggctcagaggtgcttgtaccgtgatgtgatgctagagaacctggctctcatatcctcgctggatcctgcactggatggatcagcggacaacacacagaccggtaatctgggtcaatcagttctgccatcccacccagaacagaaaacagcatgaaaaactcactttaaccccctatgaatccatctccaaccagactgatcagcactccccacttcccaagcccctacccgccaaattttgaaaactctgatcccagaatgctcagggagactgatttgaataataaaactcctgtctcccgaacagcaggacggctctgcgtgaattactatttctccatcgcaattccccagtcttcataaatcggctctgtctaggcagctggcaacgtgaacccactggacggttaca

SEQ ID NO: 4428 - DNA, 513 bp, synthetic construct
  misc_feature 1..513: note = Synthetic polypeptide
  source 1..513: mol_type = other DNA
atggcagcggctgcgccgaggcgcccgactcagcagggcactgtgacctttgaagatgtggctgtgaacttttcccaggaggagtggtgtcttcttagtgaggctcagaggtgcttgtaccgtgatgtgatgctagagaacctggctctcatatcctcgctggatcctgcactggatggatcagcggacaacacacagaccggtaatctgggtcaatcagttctgccatcccacccagaacagaaaacagcatgaaaaactcactttaaccccctatgaatccatctccaaccagactgatcagcactccccacttcccaagcccctacccgccaaattttgaaaactctgatcccagaatgctcagggagactgatttgaataataaaactcctgtctcccgaacagcaggacggctctgcgtgaattactatttctccatcgcaattccccagtcttcataaatcggctctgtctaggcagctggcaacgtgaacccactggacggttaca

SEQ ID NO: 4429 - DNA, 510 bp, synthetic construct
  misc_feature 1..510: note = Synthetic polypeptide
  source 1..510: mol_type = other DNA
atggcagcggctgcgccgaggcgcccgactcagggcactgtgacctttgaagatgtggctgtgaacttttcccaggaggagtggtgtcttcttagtgaggctcagaggtgcttgtaccgtgatgtgatgctagagaacctggctctcatatcctcgctggatcctgcactggatggatcagcggacaacacacagaccggtaatctgggtcaatcagttctgccatcccacccagaacagaaaacagcatgaaaaactcactttaaccccctatgaatccatctccaaccagactgatcagcactccccacttcccaagcccctacccgccaaattttgaaaactctgatcccagaatgctcagggagactgatttgaataataaaactcctgtctcccgaacagcaggacggctctgcgtgaattactatttctccatcgcaattccccagtcttcataaatcggctctgtctaggcagctggcaacgtgaacccactggacggttaca

SEQ ID NO: 4430 - DNA, 514 bp, synthetic construct
  misc_feature 1..514: note = Synthetic polypeptide
  source 1..514: mol_type = other DNA
gtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgacctgggagcgtctcgagggcagggtccgggtctgactcgtctctatgtcccccacgcccggcccagggctggccacagagtaggtg

SEQ ID NO: 4431 - DNA, 769 bp, synthetic construct
  misc_feature 1..769: note = Synthetic polypeptide
  source 1..769: mol_type = other DNA
atgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgacctgggagcgtctcgagggcagggtccgggtctgactcgtctctatgtcccccacgcccggcccagggctggccacagagtaggtg

SEQ ID NO: 4432 - DNA, 583 bp, synthetic construct
  misc_feature 1..583: note = Synthetic polypeptide
  source 1..583: mol_type = other DNA
ggccgagggggctttggcgggggccgaggtcgaggcggaggctttagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgacctgggagcgtctcgagggcagggtccgggtctgactcgtctctatgtcccccacgcccggcccagggctggccacagagtaggtg

SEQ ID NO: 4433 - DNA, 697 bp, synthetic construct
  misc_feature 1..697: note = Synthetic polypeptide
  source 1..697: mol_type = other DNA
atgaagccaggattcagtccccgtgggggtggctttggcggccgagggggctttggtgaccgtggtggtcgtggaggccgagggggctttggcgggggccgaggtcgaggcggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgacctgggagcgtctcgagggcagggtccgggtctgactcgtctctatgtcccccacgcccggcccagggctggccacagagtaggtg

SEQ ID NO: 4434 - DNA, 658 bp, synthetic construct
  misc_feature 1..658: note = Synthetic polypeptide
  source 1..658: mol_type = other DNA
atgaagccaggattcagtccccgtgggggtggctttggcggccgagggggctttggtgaccgtggtggtcgtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgacctgggagcgtctcgagggcagggtccgggtctgactcgtctctatgtcccccacgcccggcccagggctggccacagagtaggtg

SEQ ID NO: 4435 - DNA, 168 bp, synthetic construct; identical to SEQ ID NO: 2538
  misc_feature 1..168: note = Synthetic polypeptide
  source 1..168: mol_type = other DNA

SEQ ID NO: 4436 - DNA, 825 bp, synthetic construct
  misc_feature 1..825: note = Synthetic polypeptide
  source 1..825: mol_type = other DNA
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgggg

SEQ ID NO: 4437 - DNA, 762 bp, synthetic construct
  misc_feature 1..762: note = Synthetic polypeptide
  source 1..762: mol_type = other DNA
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttgtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgggg

SEQ ID NO: 4438 - DNA, 1026 bp, synthetic construct
  misc_feature 1..1026: note = Synthetic polypeptide
  source 1..1026: mol_type = other DNA
atggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgctgactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtttgctgtgtgatcttggacgagttactgaaccttgctgtgtttcttcatcaatgaagtggaatcatcatggactccatctcatcagattgttttgaagagtaagtgagataatggacacacagtgcccagcacagagcctgacctagagtatgccct

SEQ ID NO: 4439 - DNA, 238 bp, synthetic construct
  misc_feature 1..238: note = Synthetic polypeptide
  source 1..238: mol_type = other DNA
atgggactagctggcgtgtgcgccctgagacgctcagcgggctatatactcgtcggtggggccggcggtcagtctgcggcagcggcagcaagacggtacagtgaaggagagtgggcgtctggcggggtccgcagtttcagcagagccgctgcagccatggccccaatcaaggtgggagatgccatcccagcagtggaggccctgggccagattacttcctccacccctccctatctca

SEQ ID NO: 4440 - DNA, 494 bp, synthetic construct; identical to SEQ ID NO: 1298
  misc_feature 1..494: note = Synthetic polypeptide
  source 1..494: mol_type = other DNA

SEQ ID NO: 4441 - DNA, 1119 bp, synthetic construct; identical to SEQ ID NO: 2066
  misc_feature 1..1119: note = Synthetic polypeptide
  source 1..1119: mol_type = other DNA

SEQ ID NO: 4442 - DNA, 2364 bp, synthetic construct; identical to SEQ ID NO: 2067
  misc_feature 1..2364: note = Synthetic polypeptide
  source 1..2364: mol_type = other DNA

SEQ ID NO: 4443 - DNA, 2421 bp, synthetic construct; identical to SEQ ID NO: 2068
  misc_feature 1..2421: note = Synthetic polypeptide
  source 1..2421: mol_type = other DNA

SEQ ID NO: 4444 - DNA, 1521 bp, synthetic construct
  misc_feature 1..1521: note = Synthetic polypeptide
  source 1..1521: mol_type = other DNA
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcaggggtgggtgggtgggaggggg

SEQ ID NO: 4445 - DNA, 810 bp, synthetic construct
  misc_feature 1..810: note = Synthetic polypeptide
  source 1..810: mol_type = other DNA
atggcgcagaacgtgtatggtccgggagtccggataggcaactggaatgaggatgtctacctggaggaggagctcatgaaagacttcttagagaagagagacaaggggaaacttctcatacagagaagtagaagactaaaacagaatctcttgagaccgatgcaactttccgtaactgaagatggctatattcattacggtgacaaagtgatgcttgtgaatcctgatgatcctgacacagaagctgatgtgtttctgcgtggggacctgagcctgtgtatgactccagatgaaattcagtcccatctgaaagacgaattagaggtaccctgtggcctgagcgcagttcaagccaagaccccaattggcagaaacacttttatcattttgagtgtacacagagatgccactggtcaagtccttagatatgggcaggacttttgcctggggataacaggaggatttgacaacaaaatgttgtatttgtcaagtgaccacaggaccctcctgaaatcgtctaagaggtcttggctccaggaagtgtacctaacagatgaggtctcccatgtgaactgctggcaggctgccttccctgacccccagttacgcctggaatatgaaggcttccccgtcccgtacccgctcttttcactttaaatattgaggtccccggaccctcttcgggaaaaagcatggaccaccgatttttcctgttggcctgtgttctttttggtggacgcatctttgaccttggcaaataaacctcttaaaataattgagactcgcctcaataattttctttgatttata

SEQ ID NO: 4446 - DNA, 5629 bp, synthetic construct
  misc_feature 1..5629: note = Synthetic polypeptide
  source 1..5629: mol_type = other DNA
atggcggacggggcaccccggccccagctttaccgcagcgtctcgttcaagctgctggagcgctggagcggcggccccgggctgagggaggaggacacggacacccccggcttgaggcgacgcgcctcgtgccggccgaccacggctgcccggggccagccctctcggcgcgtgtccaagctggcgtctgggcccctggccgcccccgcgcagccgcgcccgctccgcagcctctcgccgtcggttcgccagctctcccggcgcttcgacgcgccgcgtctggacgacggctccgctgggacccgagacggaggcgtcttacccgcggccgcggaagaagcggccgagggcccagcgcgaggagcctggcccagcgtcaccgagatgcgcaagctcttcggcggtcctggctccaggaggcccagcgccgactctgaatccccaggaacgcccagccccgacggtgccgcgtgggagcctccggctcgggagtcgcggcagccaccgacgccaccccctcggacatgcttccccctggcgggtctgcgttcggcgcggcccctgaccgggccggagaccgaagggaggctgcgccggccgcagcagcaacaggagcgggcgcagcgtccagcggatggtttacattcttggcatatcttctcccaaccgcaggccggggcccgggcctcctgctcctcctcctccatcgccgcctcctatcctgtcagccgcagtcgtgctgccagctccagcgaggaggaagaggagggcccgccgcagctgcctggagcccagagtccggcctaccacggcggccactcctcgggcagtgacgacgaccgagacggtgagggcggccaccgctggggagggaggcccgggctcaggcctggaagctccctattggatcaggactgcaggcctgacagtgatgggttaaatctaagcagcatgaactcagcaggggtttctgggagccctgagcccccaacatctccaagagcccctagagaagaaggactccgggagtggggtagtggctctccgccctgcgtcccaggtccccaggagggacttcggcctatgtctgactctgtgggaggagctttccgtgtggccaaggtgagctttccctcgtacctggccagccccgcaggctcccgcggtagcagccgttattccagcacggagaccctcaaggacgacgacctatggtctagtaggggttctgggggctggggcgtgtaccgctcccctagctttggagctggggaagggctcctgcggtcccaggctcgaacccgtgccaaaggacctggaggcacctctagggcattgagggatggaggatttgagcctgaaaagagtcgacagcggaagtccctgtcaaatccagatatcgcctcagagaccctgacgcttctcagtttcctgcgctcagacctttcagagctgagggtccgaaaacctggtgggagctccggggaccgtggaagcaaccccctagatggcagagactcaccatccgcaggtggccctgtggggcaacttgaacccatacccatcccagccccagcatcacctggcacgcgccccacactcaaggacttgacagccactctgcggagagcaaagtcattcacctgctctgagaagcccatggcccgccgcctgccccgcaccagtgctctgaagtccagctcctccgagctcctgctcacaggccctggtgccgaggaggatccgctgcccctcatcgtccaggaccaatatgtgcaggaggcccgccaggtttttgagaagatccagcgcatgggtgcccaacaagatgatggaagcgatgccccccctggaagccctgactgggcaggggatgtgacccgagggcagcggtcccaggaggagctctcaggccctgagtccagtctgacagatgaaggcattggggcagaccctgagcctcctgttgcagcattttgcggcctgggtaccacagggatgtggcgacctctttcctcatcctcggcccagacgaaccaccatggccctgggactgaggacagtctgggcgggtgggccctggtgtcgcctgagacccctcccacaccaggtgccctccgccgacgacgcaaagtcccaccttcaggttctggtgggagcgaattgagcaatggggaggcaggggaggcctacaggtccctgagtgacccaattcctcagcgccaccgggctgccacctctgaagagcctactgggttctctgtggacagcaacctcctgggctcactgagccccaagacagggctccctgccacctcagccatggatgagggcttgaccagtggtcacagtgactggtctgtgggcagtgaagagagcaagggatatcaggaggttattcagagcatagttcaggggcctggcaccctggggcgtgtggtggacgacaggattgctggcaaagcccccaagaagaaatccctgagtgaccccagccgccgtggggagctggctgggcctggattcgagggccctggaggggagcccatccgagaagttgagcccatgctgcctccatccagcagcgagcccatccttgtagagcagcgggcagagccagaagaacctggtgccaccaggagccgggcacagtctgaaagggccctacctgaggctctgcctccccctgccactgcccaccgaaactttcaccttgaccccaagctggctgacattctgtccccgaggctaatccgccgaggctccaagaagcgcccagctcggagtagtcaccaggagcttcggagagacgagggcagtcaggaccagactggcagcctgtctcgggcccggccctcctccagacacgttcgccatgccagtgtgcccgccacatttatgcctattgtggtgcctgagccaccaacttctgttggtccccctgtggctgtgccagaacccataggcttccctacccgagcccatcccacgttgcaggcaccatcgctcgaggacgtcaccaagcagtacatgctgaacctgcactccggtgaggtccctgccccagtgccagtggacatgccctgcttgcctctggctgcaccgccctctgctgaggccaagccccctgaggcagctcggcctgcagatgagcctacccctgccagcaagtgctgcagcaagccacaggtggacatgcggaagcacgtggccatgaccctgctggacacagagcagtcgtatgtggagtcgctgcgcaccctgatgcagggctacatgcagccgctgaagcagccagagaactccgtgctctgtgacccttcactggtggacgagatcttcgaccagatccccgagctcctggagcaccacgagcaattcctggagcaggttcggcactgcatgcagacctggcatgcccagcagaaggtgggagccctgctcgtccagtcgttctccaaggatgtcctagtaaacatctattctgcctatatcgataacttcctcaatgcaaaggatgctgtgcgtgtggccaaggaggcgaggcctgcctttctcaagttcctagagcaaagcatgcgtgagaacaaggagaagcaggcgctgtctgacctcatgatcaagcctgtgcagcggatcccacgctacgagcttctggtgaaggacctcctgaagcatacacctgaggaccacccggaccatccactcctgctggaggcgcagcggaacatcaagcaggtggctgagcgcatcaacaagggtgtgcggagtgccgaggaggcggagcgccatgcccgtgtgctgcaggagatagaggctcacatcgagggcatggaggatctccaggcccctctgcggcggttcctgagacaggagatggtcattgaagtgaaggcgatcggtggcaagaaggaccggtctctcttcctgttcacggacctcatcgtctgcaccactctgaagcgaaagtcaggctccctgcggcgcagctccatgagcctgtacacggcagccagtgtcattgacacagccagcaagtacaagatgctgtggaagctgccgctggaagacgcagacatcatcaaaggggcatcccaagccaccaatcgggagaacatccagaaggccatcagccgccttgatgaggacctcaccaccctgggccaaatgagcaagctctctgagagccttggtttcccccaccagagcctggacgatgcactgcgggacctctcagctgccatgcaccgggacctgtcggagaagcaggcgctgtgctacgcgctttccttcccgccaaccaagctggagctgtgcgccactcggcccgagggcaccgactcctacatttttgagttccctcaccctgacgcccgccttggttttgaacaggccttcgatgaggccaagaggaagctggcatccagcaaaagctgtctagaccctgagttcctgaaggccatccccatcatgaaaacccgcagtggcatgcagttctcctgtgcggctcccaccctgaacagctgcccggagccctcgcctgaggtatgggtctgcaacagcgacggctacgtgggccaggtgtgcctgctgagcctgcgcgccgagccggacgtggaggcctgcatcgccgtctgttccgcccgcatcctctgcatcggggcggtgcccgggctgcagcctcgctgccaccgggagcctcctccgtcgctgaggagtcctccagagacggcaccggagcccgccgggccggagctggacgtcgaggccgctgcagacgaggaagccgcgacgctcgcggagccggggccgcagccctgccttcacatctccattgcaggctcgggcttggagatgacgccgggcctcggcgagggtgacccccgcccagagctggtgccctttgacagtgactctgacgatgagtcttcgcccagcccctcggggacgctgcagagccaggccagccggtccaccatctcctccagctttggcaatgaggagaccccgagttccaaggaggccacggcagagaccaccagctcagaggaggagcaggagccaggcttcctgccactgtctggctcctttgggcctggtggtccctgcggcaccagcccaatggatgggagagcccttcgccgctccagccacggctccttcacccggggcagccttgaggacctgctgagtgtcgaccctgaggcctaccagagctccgtgtggctgggcactgaggatggctgtgtccacgtgtaccagtcctccgacagcatccgtgaccgcaggaacagcatgaagctccagcatgcggcctctgtgacctgcatcttgtatctgaataaccaggtgtttgtgtctctggccaatggagagcttgtggtctaccaaagggaagcaggccatttctgggacccccagaacttcaaatcagtgaccttgggcacccaggggagccccatcaccaagatggtatctgtgggtgggcggctgtggtgtggctgccagaaccgagtccttgtcctgagccctgacacgctgcagctggaggcttcagcttccccacctgtccagggggaggccagtgactgattttagaaccctttaagcattgaagttctctgatcct

SEQ ID NO: 4447 - DNA, 3628 bp, synthetic construct; identical to SEQ ID NO: 330
  misc_feature 1..3628: note = Synthetic polypeptide
  source 1..3628: mol_type = other DNA

SEQ ID NO: 4448 - DNA, 3127 bp, synthetic construct; identical to SEQ ID NO: 332
  misc_feature 1..3127: note = Synthetic polypeptide
  source 1..3127: mol_type = other DNA

SEQ ID NO: 4449 - DNA, 2713 bp, synthetic construct; identical to SEQ ID NO: 1273
  misc_feature 1..2713: note = Synthetic polypeptide
  source 1..2713: mol_type = other DNA

SEQ ID NO: 4450 - DNA, 228 bp, synthetic construct; identical to SEQ ID NO: 1274
  misc_feature 1..228: note = Synthetic polypeptide
  source 1..228: mol_type = other DNA

SEQ ID NO: 4451 - DNA, 383 bp, synthetic construct
  misc_feature 1..383: note = Synthetic polypeptide
  source 1..383: mol_type = other DNA
atggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagaatctcttgaactccggagggggaggttgcagtgagccaagatcgcaccattgcactccagcctgggtaacaagagggaaacttcgtctcaaaaaggaaaa

SEQ ID NO: 4452 - DNA, 248 bp, synthetic construct
  misc_feature 1..248: note = Synthetic polypeptide
  source 1..248: mol_type = other DNA
atggcgcagtctattaacatcacggagctgaatctgccgcagctagaaatgctcaagaaccagctggaccagatgtatgtccctgggaagctgcatgatgtggaacacgtgctcatcgatgtgggaactgggtactatgtagagaagaatctcttgaactccggagggggaggttgcagtgagccaagatcgcaccattgcactccagcctgggtaacaagagggaaacttcgtctcaaaaaggaaaa

SEQ ID NO: 4453 - DNA, 375 bp, synthetic construct
  misc_feature 1..375: note = Synthetic polypeptide
  source 1..375: mol_type = other DNA
taacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggacggaatttcgctctgtcgcccaggctggagcgcaatgatgtatgtccctgggaagctgcatgatgtggaacacgtgctcatcgatgtgggaactgggtactatgtagagaagaatctcttgaactccggagggggaggttgcagtgagccaagatcgcaccattgcactccagcctgggtaacaagagggaaacttcgtctcaaaaaggaaaa

SEQ ID NO: 4454 - DNA, 147 bp, synthetic construct
  misc_feature 1..147: note = Synthetic polypeptide
  source 1..147: mol_type = other DNA
atgatgcctgggcagatcccggacccttcggtgaccacaggctccctgccagggcttggccccctgaccgggctccccagctcggccctgactgtggaggaggaggaagaggagaaggaaaagtgacgaagagagaggaggaggggg

SEQ ID NO: 4455 - DNA, 180 bp, synthetic construct
  misc_feature 1..180: note = Synthetic polypeptide
  source 1..180: mol_type = other DNA
atggtagcaggctggcctgccactcctcctgctatgatgcctgggcagatcccggacccttcggtgaccacaggctccctgccagggcttggccccctgaccgggctccccagctcggccctgactgtggaggaggaggaagaggagaaggaaaagtgacgaagagagaggaggaggggg

SEQ ID NO: 4456 - DNA, 1156 bp, synthetic construct; identical to SEQ ID NO: 1222
  misc_feature 1..1156: note = Synthetic polypeptide
  source 1..1156: mol_type = other DNA

SEQ ID NO: 4457 - DNA, 919 bp, synthetic construct; identical to SEQ ID NO: 1223
  misc_feature 1..919: note = Synthetic polypeptide
  source 1..919: mol_type = other DNA

SEQ ID NO: 4458 - DNA, 941 bp, synthetic construct; identical to SEQ ID NO: 1224
  misc_feature 1..941: note = Synthetic polypeptide
  source 1..941: mol_type = other DNA

SEQ ID NO: 4459 - DNA, 689 bp, synthetic construct
  misc_feature 1..689: note = Synthetic polypeptide
  source 1..689: mol_type = other DNA
atggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaaga

SEQ ID NO: 4460 - DNA, 803 bp, synthetic construct; identical to SEQ ID NO: 152
  misc_feature 1..803: note = Synthetic polypeptide
  source 1..803: mol_type = other DNA

SEQ ID NO: 4461 - DNA, 1257 bp, synthetic construct
  misc_feature 1..1257: note = Synthetic polypeptide
  source 1..1257: mol_type = other DNA
atgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggttcattgcaataggtgattcacattctccaaacctgctttgtctaatatgtgatgaccagctatccagaaaagccatgaaacctttaaaagtgcttcaccacatggagaccaaacaccctgcattaaaagacaagcctttggagtttttcaaaagaaaaaatcgtgaacgcaaagaacagaagtaattattgaaggccaccacttcatcaaatgtgtctgcagtgagagcatcattcttagtggctaatcacattgctaaagctaagaaggcctttactactggtgaagagttgatcctgcctgctgctaaggacatctgttgtgaactcttaggagagcctgcagttcaaaaggtggcacatgttcctcttctggctagcaccatagctagatgaattaatagaggatatgaggcacagttgttagaattaatgagtcactgtggtacccaatccaggttaatgagtctaccagtgttgacagcaaggcaacaatgcttgtttttgtgtgatacatttttcaggaggatgtgcatgaggatatattatgtgcacttttgctttcaaccaacaccacagctgcagaactattcaagtctttaaatacatatcaggaaaactgaattggtcattttgtatcgatatatgcagggatggagcagctgccatgactggacggctttctgttttcactactcaggtcaaagagcttgcttctgaatgtgagtctgtgtactgtgtcatctgtagagatgctggctagttggaaaatgccacctgaacttaccattttgtaggatgtgcttaaaattttcaaccacattaaagtacatgcccttaattcacatctgttcatgtagctctgtgagaagatagacacagagcacacgtcttctcttatacacagaagagagacggcttcctaaaggtagatcactggccactgtttttcagttacaatagctgctccagagatttcattttagaaaaagtcaccactggcagcacatttcgttgacacagaattgggtcacaaaattgcttactt

SEQ ID NO: 4462 - DNA, 1173 bp, synthetic construct
  misc_feature 1..1173: note = Synthetic polypeptide
  source 1..1173: mol_type = other DNA
atgagtgctgccagagagtctcacccgcatggggtgaagcgttcagcctccccagacgacgataaagaacatactggtcgtcttgttataggagatcacaaatcaacatctcacttccgaaccggttcattgcaataggtgattcacattctccaaacctgctttgtctaatatgtgatgaccagctatccagaaaagccatgaaacctttaaaagtgcttcaccacatggagaccaaacaccctgcattaaaagacaagcctttggagtttttcaaaagaaaaaatcgtgaacgcaaagaacagaagtaattattgaaggccaccacttcatcaaatgtgtctgcagtgagagcatcattcttagtggctaatcacattgctaaagctaagaaggcctttactactggtgaagagttgatcctgcctgctgctaaggacatctgttgtgaactcttaggagagcctgcagttcaaaaggtggcacatgttcctcttctggctagcaccatagctagatgaattaatagaggatatgaggcacagttgttagaattaatgagtcactgtggtacccaatccaggttaatgagtctaccagtgttgacagcaaggcaacaatgcttgtttttgtgtgatacatttttcaggaggatgtgcatgaggatatattatgtgcacttttgctttcaaccaacaccacagctgcagaactattcaagtctttaaatacatatcaggaaaactgaattggtcattttgtatcgatatatgcagggatggagcagctgccatgactggacggctttctgttttcactactcaggtcaaagagcttgcttctgaatgtgagtctgtgtactgtgtcatctgtagagatgctggctagttggaaaatgccacctgaacttaccattttgtaggatgtgcttaaaattttcaaccacattaaagtacatgcccttaattcacatctgttcatgtagctctgtgagaagatagacacagagcacacgtcttctcttatacacagaagagagacggcttcctaaaggtagatcactggccactgtttttcagttacaatagctgctccagagatttcattttagaaaaagtcaccactggcagcacatttcgttgacacagaattgggtcacaaaattgcttactt

SEQ ID NO: 4463 - DNA, 1125 bp, synthetic construct
  misc_feature 1..1125: note = Synthetic polypeptide
  source 1..1125: mol_type = other DNA
atgggtgcaggaaagaaagaacatactggtcgtcttgttataggagatcacaaatcaacatctcacttccgaaccggttcattgcaataggtgattcacattctccaaacctgctttgtctaatatgtgatgaccagctatccagaaaagccatgaaacctttaaaagtgcttcaccacatggagaccaaacaccctgcattaaaagacaagcctttggagtttttcaaaagaaaaaatcgtgaacgcaaagaacagaagtaattattgaaggccaccacttcatcaaatgtgtctgcagtgagagcatcattcttagtggctaatcacattgctaaagctaagaaggcctttactactggtgaagagttgatcctgcctgctgctaaggacatctgttgtgaactcttaggagagcctgcagttcaaaaggtggcacatgttcctcttctggctagcaccatagctagatgaattaatagaggatatgaggcacagttgttagaattaatgagtcactgtggtacccaatccaggttaatgagtctaccagtgttgacagcaaggcaacaatgcttgtttttgtgtgatacatttttcaggaggatgtgcatgaggatatattatgtgcacttttgctttcaaccaacaccacagctgcagaactattcaagtctttaaatacatatcaggaaaactgaattggtcattttgtatcgatatatgcagggatggagcagctgccatgactggacggctttctgttttcactactcaggtcaaagagcttgcttctgaatgtgagtctgtgtactgtgtcatctgtagagatgctggctagttggaaaatgccacctgaacttaccattttgtaggatgtgcttaaaattttcaaccacattaaagtacatgcccttaattcacatctgttcatgtagctctgtgagaagatagacacagagcacacgtcttctcttatacacagaagagagacggcttcctaaaggtagatcactggccactgtttttcagttacaatagctgctccagagatttcattttagaaaaagtcaccactggcagcacatttcgttgacacagaattgggtcacaaaattgcttactt

SEQ ID NO: 4464 - DNA, 202 bp, synthetic construct
  misc_feature 1..202: note = Synthetic polypeptide
  source 1..202: mol_type = other DNA
atgttccaggtcccggatagcgagggcggccgcgccggctccagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggcgagtcc

SEQ ID NO: 4465 - DNA, 286 bp, synthetic construct
  misc_feature 1..286: note = Synthetic polypeptide
  source 1..286: mol_type = other DNA
atgttccaggtcccggatagcgagggcggccgcgccggctccaggaaatggcaactgctgacaggaagtttggcatccacctcccccagcctcctgagtggacaggggccctgggcaccacttcagagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggcgagtcc

SEQ ID NO: 4466 - DNA, 154 bp, synthetic construct
  misc_feature 1..154: note = Synthetic polypeptide
  source 1..154: mol_type = other DNA
atgaagcccccaggaggagaatcgagcaatctttttggaagtccagaagaagctactccttccagcaggcctaataggatggcatctaatatttttggaccaacagaagaacctcagaacatacccaagaggacaaatcccccagggcgagtcc

SEQ ID NO: 4467 - DNA, 166 bp, synthetic construct
  misc_feature 1..166: note = Synthetic polypeptide
  source 1..166: mol_type = other DNA
atgatgagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggcgagtcc

SEQ ID NO: 4468 - DNA, 97 bp, synthetic construct
  misc_feature 1..97: note = Synthetic polypeptide
  source 1..97: mol_type = other DNA
ccttccagcaggcctaataggatggcatctaatatttttggaccaacagaagaacctcagaacatacccaagaggacaaatcccccagggcgagtcc

SEQ ID NO: 4469 - DNA, 6504 bp, synthetic construct
  misc_feature 1..6504: note = Synthetic polypeptide
  source 1..6504: mol_type = other DNA
atggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcaggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagtatctcagcagaaatggaataatggatatctcaagggacaatttcagcttcagtgcaaaaataagagtgggtgacttctatgaagccagagatggaccgcagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatcatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaaccattatgttatgaggatgctttagcagcccagccctatggagcagccaatagctaccaccagcttaccagccctgtgcctgaggcatcttagaagtggatcctttagcccaagttaaacattcagatgaccggagccccagccaacatctcgactgaaacttcataagcaaccctgagccagaactatccagctaagccactcctgatttcttgacccacaaaaactatgagataataaatgtttattgttggtttaaaccactccgttttgaataatttgttatccgtcaatagataactaata

SEQ ID NO: 4470 - DNA, 6702 bp, synthetic construct
  misc_feature 1..6702: note = Synthetic polypeptide
  source 1..6702: mol_type = other DNA
atggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccaggtgcagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcagaatcagatagtaattcagaatcagatacagaaggatcagaagaagaagatgatgatgataaagaccaagatgaatcagatagtgatactgaaggagagaaaacttcaatgaaactgaataaaacaacttcctctgtcaaaagcccttccatgagtctcacaggtcactcaacacctcgtaacctccacatagcaaaagccccaggctctgctcctgctgccttatgttctgaatcccagtcacctgcttttcttggtacatcttcttccacacttacttcaagcccacactctggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatcatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaaccattatgttatgaggatgctttagcagcccagccctatggagcagccaatagctaccaccagcttaccagccctgtgcctgaggcatcttagaagtggatcctttagcccaagttaaacattcagatgaccggagccccagccaacatctcgactgaaacttcataagcaaccctgagccagaactatccagctaagccactcctgatttcttgacccacaaaaactatgagataataaatgtttattgttggtttaaaccactccgttttgaataatttgttatccgtcaatagataactaata

SEQ ID NO: 4471 - DNA, 6696 bp, synthetic construct
  misc_feature 1..6696: note = Synthetic polypeptide
  source 1..6696: mol_type = other DNA
atggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcagaatcagatagtaattcagaatcagatacagaaggatcagaagaagaagatgatgatgataaagaccaagatgaatcagatagtgatactgaaggagagaaaacttcaatgaaactgaataaaacaacttcctctgtcaaaagcccttccatgagtctcacaggtcactcaacacctcgtaacctccacatagcaaaagccccaggctctgctcctgctgccttatgttctgaatcccagtcacctgcttttcttggtacatcttcttccacacttacttcaagcccacactctggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatcatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaaccattatgttatgaggatgctttagcagcccagccctatggagcagccaatagctaccaccagcttaccagccctgtgcctgaggcatcttagaagtggatcctttagcccaagttaaacattcagatgaccggagccccagccaacatctcgactgaaacttcataagcaaccctgagccagaactatccagctaagccactcctgatttcttgacccacaaaaactatgagataataaatgtttattgttggtttaaaccactccgttttgaataatttgttatccgtcaatagataactaata

SEQ ID NO: 4472 - DNA, 6804 bp, synthetic construct
  misc_feature 1..6804: note = Synthetic polypeptide
  source 1..6804: mol_type = other DNA
atggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccaggtgcagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcagaatcagatagtaattcagaatcagatacagaaggatcagaagaagaagatgatgatgataaagaccaagatgaatcagatagtgatactgaaggagagaaaacttcaatgaaactgaataaaacaacttcctctgtcaaaagcccttccatgagtctcacaggtcactcaacacctcgtaacctccacatagcaaaagccccaggctctgctcctgctgccttatgttctgaatcccagtcacctgcttttcttggtacatcttcttccacacttacttcaagcccacactctggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagtatctcagcagaaatggaataatggatatctcaagggacaatttcagcttcagtgcaaaaataagagtgggtgacttctatgaagccagagatggaccgcagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatcatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaaccattatgttatgaggatgctttagcagcccagccctatggagcagccaatagctaccaccagcttaccagccctgtgcctgaggcatcttagaagtggatcctttagcccaagttaaacattcagatgaccggagccccagccaacatctcgactgaaacttcataagcaaccctgagccagaactatccagctaagccactcctgatttcttgacccacaaaaactatgagataataaatgtttattgttggtttaaaccactccgttttgaataatttgttatccgtcaatagataactaata

SEQ ID NO: 4473 - DNA, 489 bp, synthetic construct
  misc_feature 1..489: note = Synthetic polypeptide
  source 1..489: mol_type = other DNA
atgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgagagccagggcagcttctcggggctggaaatattctctgtcttgatcttggagccggttttactggtatgttgagtt

SEQ ID NO: 4474 - DNA, 645 bp, synthetic construct
  misc_feature 1..645: note = Synthetic polypeptide
  source 1..645: mol_type = other DNA
atgtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgagagccagggcagcttctcggggctggaaatattctctgtcttgatcttggagccggttttactggtatgttgagtt

SEQ ID NO: 4475 - DNA, 726 bp, synthetic construct
  misc_feature 1..726: note = Synthetic polypeptide
  source 1..726: mol_type = other DNA
cagatgatgaacttattgacgggcggacagaaactgtgtgctgattgtcacgttctgatttggctctgcggagttctttggccttctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgagagccagggcagcttctcggggctggaaatattctctgtcttgatcttggagccggttttactggtatgttgagtt

SEQ ID NO: 4476 - DNA, 739 bp, synthetic construct
  misc_feature 1..739: note = Synthetic polypeptide
  source 1..739: mol_type = other DNA
ggtatgtgttgtaatggcggccgtttcattgtcaccggcgtcggcacggctgaatccgcgacgcatcgccgccatcccgtcttggccggcgccggggtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgagagccagggcagcttctcggggctggaaatattctctgtcttgatcttggagccggttttactggtatgttgagtt

SEQ ID NO: 4477 - DNA, 2163 bp, synthetic construct
  misc_feature 1..2163: note = Synthetic polypeptide
  source 1..2163: mol_type = other DNA
atgggagaaactgagaaaagaattgaaacccatagaataagatgtctttccaagttgaagatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgaggtgtatgaaatctgaagagaagtcccttggtgtgggattacatacattttgcacaagagtatttgctggcattcctgcacctatatattttggcgctttaatggattccacatgtttacactggggaactttgaaatgtggtgagtcaggggcatgcaggatatatgattccaccaccttcagatcctgaacttcacagatgagctcacaccacccagattgataaactggcctatctcatcctgtggccccctcccaggaagtgactcagcacgagaggacagtatcaactccctatgatttcatctctcacctgaccaatcagaactcttgactcactggcccccctacccaccaaattatctttaaaaactccagtcctcaaattctcagagagactgatttgaataataacaaaactctggtgtactgcacagctggctctgcatgaattactctttattgcaatttctctgttttgataagtaagatctttcttgataaataagctctgtctaggcagtgggcaaggtgaacccgttaggtggttaca

SEQ ID NO: 4478 - DNA, 1767 bp, synthetic construct
  misc_feature 1..1767: note = Synthetic polypeptide
  source 1..1767: mol_type = other DNA
atggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgaggtgtatgaaatctgaagagaagtcccttggtgtgggattacatacattttgcacaagagtatttgctggcattcctgcacctatatattttggcgctttaatggattccacatgtttacactggggaactttgaaatgtggtgagtcaggggcatgcaggatatatgattccaccaccttcagatcctgaacttcacagatgagctcacaccacccagattgataaactggcctatctcatcctgtggccccctcccaggaagtgactcagcacgagaggacagtatcaactccctatgatttcatctctcacctgaccaatcagaactcttgactcactggcccccctacccaccaaattatctttaaaaactccagtcctcaaattctcagagagactgatttgaataataacaaaactctggtgtactgcacagctggctctgcatgaattactctttattgcaatttctctgttttgataagtaagatctttcttgataaataagctctgtctaggcagtgggcaaggtgaacccgttaggtggttaca

SEQ ID NO: 4479 - DNA, 253 bp, synthetic construct
  misc_feature 1..253: note = Synthetic polypeptide
  source 1..253: mol_type = other DNA
atggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgctgggtaagtggtagctct

SEQ ID NO: 4480 - DNA, 1052 bp, synthetic construct
  misc_feature 1..1052: note = Synthetic polypeptide
  source 1..1052: mol_type = other DNA
atgagaggggtttcctgtctccaggtcctgctccttctggtgctgggagctgctgggactcagggaaggaagtctgcagcctgcgggcagccccgcatgtccagtcggatcgttgggggccgggatggccgggacggagagtggccgtggcaggcgagcatccagcatcgtggggcacacgtgtgcggggggtcgctcatcgccccccagtgggtgctgacagcggcgcactgcttccccaggagggcactgccagctgagtaccgcgtgcgcctgggggcgctgcgtctgggctccacctcgccccgcacgctctcggtgcccgtgcgacgggtgctgctgcccccggactactccgaggacggggcccgcggcgacctggcactgctgcagctgcgtcgcccggtgcccctgagcgctcgcgtccaacccgtctgcctgcccgtgcccggcgcccgcccgccgcccggcacaccatgccgggtcaccggctggggcagcctccgcccaggagtgcccctcccagagtggcgaccgctacaaggagtaagggtgccgctgctggactcgcgcacctgcgacggcctctaccacgtgggcgcggacgtgccccaggctgagcgcattgtgctgcctgggagtctgtgtgccggctacccccagggccacaaggacgcctgccagtcagattcacagcatgacagagatttgacaccagggagatcctccatagctggctttgaggacacggggaccacagccatgagcggcctctaagagctgagagacagccggcagggaatcggaaccctcagacccacagccgcaaggcactggattctggcagcaccctgaaggagctgggaagtaagttcttccccagcctccagataagagccccgccggccaatcccttcatttcaacctaaagagaccctaagcagagaacctagctgagccactcctgacctacaaagttgtgacttaataaatgtgtgctttaagctgctccatttgtgctgacttgttatacagcaataaaaactaatata

SEQ ID NO: 4481 - DNA, 1019 bp, synthetic construct
  misc_feature 1..1019: note = Synthetic polypeptide
  source 1..1019: mol_type = other DNA
atgagaggggtttcctgtctccaggtcctgctccttctggtgctggcctgcgggcagccccgcatgtccagtcggatcgttgggggccgggatggccgggacggagagtggccgtggcaggcgagcatccagcatcgtggggcacacgtgtgcggggggtcgctcatcgccccccagtgggtgctgacagcggcgcactgcttccccaggagggcactgccagctgagtaccgcgtgcgcctgggggcgctgcgtctgggctccacctcgccccgcacgctctcggtgcccgtgcgacgggtgctgctgcccccggactactccgaggacggggcccgcggcgacctggcactgctgcagctgcgtcgcccggtgcccctgagcgctcgcgtccaacccgtctgcctgcccgtgcccggcgcccgcccgccgcccggcacaccatgccgggtcaccggctggggcagcctccgcccaggagtgcccctcccagagtggcgaccgctacaaggagtaagggtgccgctgctggactcgcgcacctgcgacggcctctaccacgtgggcgcggacgtgccccaggctgagcgcattgtgctgcctgggagtctgtgtgccggctacccccagggccacaaggacgcctgccagtcagattcacagcatgacagagatttgacaccagggagatcctccatagctggctttgaggacacggggaccacagccatgagcggcctctaagagctgagagacagccggcagggaatcggaaccctcagacccacagccgcaaggcactggattctggcagcaccctgaaggagctgggaagtaagttcttccccagcctccagataagagccccgccggccaatcccttcatttcaacctaaagagaccctaagcagagaacctagctgagccactcctgacctacaaagttgtgacttaataaatgtgtgctttaagctgctccatttgtgctgacttgttatacagcaataaaaactaatata

SEQ ID NO: 4482 - DNA, 413 bp, synthetic construct
  misc_feature 1..413: note = Synthetic polypeptide
  source 1..413: mol_type = other DNA
atgatcgcacggcggaacccagaacccttacggtttctgccggatgaggcccggagcctgcccccgcccaagctgaccgacccgcggctcctctacatcggcttcttgggctactgctccggcctgattgataacctaatccggcggaggccgatcgcgacggctggtttgcatcgccagcttctatatattacggcctttttttttgctggatattatcttgtaaaacgtgaagactacctgtatgctgtgagggaccgtgaaatgtttggatatatgaaattacatccagaggattttcctgaagaagaccagccccatccatcaagttaccccagagctcatcatgaatgcagattctcaggccccagccaggacctactgaattggaactgcatttcaacaagatcctc

SEQ ID NO: 4483 - DNA, 344 bp, synthetic construct
  misc_feature 1..344: note = Synthetic polypeptide
  source 1..344: mol_type = other DNA
atgatcgcacggcggaacccagaacccttacggtttctgccggatgaggcccggagcctgcccccgcccaagctgaccgacccgcggctcctctacatcggcttcttgggctactgctccggcctgattgataacctaatccggcggaggccgatcgcgacggctgactacctgtatgctgtgagggaccgtgaaatgtttggatatatgaaattacatccagaggattttcctgaagaagaccagccccatccatcaagttaccccagagctcatcatgaatgcagattctcaggccccagccaggacctactgaattggaactgcatttcaacaagatcctc

SEQ ID NO: 4484 - DNA, 1324 bp, synthetic construct; identical to SEQ ID NO: 326
  misc_feature 1..1324: note = Synthetic polypeptide
  source 1..1324: mol_type = other DNA

SEQ ID NO: 4485 - DNA, 121 bp, synthetic construct
  misc_feature 1..121: note = Synthetic polypeptide
  source 1..121: mol_type = other DNA
atgcatacgcaagactcggaggtagttccggttccggcgtggccattttcgttggtggtgttcagttgtggcggttgctggtcagtaacagccaagatgctgcggaatctgctggctctaa

SEQ ID NO: 4486 - DNA, 25 bp, synthetic construct
  misc_feature 1..25: note = Synthetic polypeptide
  source 1..25: mol_type = other DNA
atgctgcggaatctgctggctctaa

SEQ ID NO: 4487 - DNA, 78 bp, synthetic construct
  misc_feature 1..78: note = Synthetic polypeptide
  source 1..78: mol_type = other DNA
cattttcgttggtggtgttcagttgtggcggttgctggtcagtaacagccaagatgctgcggaatctgctggctctaa

SEQ ID NO: 4488 - DNA, 1497 bp, synthetic construct
  misc_feature 1..1497: note = Synthetic polypeptide
  source 1..1497: mol_type = other DNA
atgtcagctcagtgctgtgcgggccagctggcctgctgctgtgggtctgcaggctgctctctctgctgtgattgctgccccaggattcggcagtccctcagcacccgcttcatgtacgccctctacttcattctggtcgtcgtcctctgctgcatcatgatgtcaacaaccgtggctcacaagatgaaagagcacattcctttttttgaagatatgtgtaaaggcattaaagctggtgacacctgtgagaagctggtgggatattctgccgtgtatagagtctgttttggaatggcttgtttcttctttatcttctgtctactgaccttgaaaatcaacaacagcaaaagttgtagagctcatattcacaatggcttttggttctttaaacttctgctgttgggggccatgtgctcaggagctttcttcattccagatcaggacacctttctgaacgcctggcgctatgtgggagccgtcggaggcttcctcttcattggcatccagctcctcctgctcgtggagtttgcacataagtggaacaagaactggacagcaggcacagccagtaacaagctgtggtacgcctccctggccctggtgacgctcatcatgtattccattgccactggaggcttggttttgatggcagtgttttatacacagaaagacagctgcatggaaaacaaaattctgctgggagtaaatggaggcctgtgcctgcttatatcattggtagccatctcaccctgggtccaaaatcgacagccacactcggggctcttacaatcaggggtcataagctgctatgtcacctacctcaccttctcagctctgtccagcaaacctgcagaagtagatgaacatgggaaaaatgttacaatctgtgtgcctgactttggtcaagacctgtacagagatgaaaacttggtgactatactggggaccagcctcttaatcggatgtatcttgtattcatgtttgacatcaacaacaagatcgagttctgacgctctgcaggggcgatacgcagctcctgaattggagatagctcgctgttgtttttgcttcagtcctggtggagaggacactgaagagcagcagccggggaaggagggaccacgggtcatttatgacgagaagaaaggcaccgtctacatctactcctacttccacttcgtgttcttcctagcttccctgtatgtgatgatgaccgtcaccaactggttcaaatggagtcccactctgttgcccaggctggagtacagtggcatgatcttggctcactgcaacctccacctcccagatgtcaagcgattctcttgcctcagcctcccaagtagctggggttacaggcatgtgccaccatgtgcctttcacctcctgccatgattctgaggcctccccagccatgtggaactgtaagtccaattaaacctctttttcttcccagtctctggtatgtctttatcagcagcatgaaaacaaactaataca

SEQ ID NO: 4489 - DNA, 1331 bp, synthetic construct
  misc_feature 1..1331: note = Synthetic polypeptide
  source 1..1331: mol_type = other DNA
atggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggcggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaa

SEQ ID NO: 4490 - DNA, 1382 bp, synthetic construct
  misc_feature 1..1382: note = Synthetic polypeptide
  source 1..1382: mol_type = other DNA
atggggtacttccggtgtgcacgtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggcggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaa

SEQ ID NO: 4491 - DNA, 1271 bp, synthetic construct
  misc_feature 1..1271: note = Synthetic polypeptide
  source 1..1271: mol_type = other DNA
atggggtacttccggtgtgcacgtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggattttggaggcaacatcaacgtggagaccatcagtgcctttattgacggcggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaa

SEQ ID NO: 4492 - DNA, 1031 bp, synthetic construct
  misc_feature 1..1031: note = Synthetic polypeptide
  source 1..1031: mol_type = other DNA
atggagcgggcgcgcgggccgcgggccgaggccgacgcgcctgaggaggaggaggaggcgggggcggccatggctgctgtggtggtggcggctgcgggtggcgcgggaccggcggtcctgcaggtggccggtctctaccggggcctgtgcgcggtgcgcagccgcgccctgggcctggggctcgtgtcacccgcgcagctgcgcgtcttcccagtgcgccccggctcgggccggcccgaggggggcgccgacagcagcggggtcggggccgaggccgagctccaggccaaccctttctacgaccgctaccgcgacaagatccagctgctgcgcaggtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacatttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacggactgtgagctccttgagggccaggacttatctctgttcgcagtgccaaggacatggcctggaccatagaagatactcagttttttgttgaataaat

SEQ ID NO: 4493 - DNA, 962 bp, synthetic construct
  misc_feature 1..962: note = Synthetic polypeptide
  source 1..962: mol_type = other DNA
atggctgctgtggtggtggcggctgcgggtggcgcgggaccggcggtcctgcaggtggccggtctctaccggggcctgtgcgcggtgcgcagccgcgccctgggcctggggctcgtgtcacccgcgcagctgcgcgtcttcccagtgcgccccggctcgggccggcccgaggggggcgccgacagcagcggggtcggggccgaggccgagctccaggccaaccctttctacgaccgctaccgcgacaagatccagctgctgcgcaggtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacatttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacggactgtgagctccttgagggccaggacttatctctgttcgcagtgccaaggacatggcctggaccatagaagatactcagttttttgttgaataaat

SEQ ID NO: 4494 - DNA, 758 bp, synthetic construct
  misc_feature 1..758: note = Synthetic polypeptide
  source 1..758: mol_type = other DNA
atggctgctgtggtggtggcggctgcgggtggcgcgggaccggcggtcctgcaggtggccggtctctaccggggcctgtgcgcggtgcgcagccgcgccctgggcctggggctcgtgtcacccgcgcagctgcgcgtcttcccagtgcgccccggctcgggccggcccgaggggggcgccgacagcagcggggtcggggccgaggccgagctccaggccaaccctttctacgaccgctaccgcgacaagatccagctgctgcgcaggtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacaaatgttgctgaggcacagtgcatcgccaaccaagttcagctcttctacgctactgatcggaaagagacctacggactgtgagctccttgagggccaggacttatctctgttcgcagtgccaaggacatggcctggaccatagaagatactcagttttttgttgaataaat

SEQ ID NO: 4495 - DNA, 374 bp, synthetic construct
  misc_feature 1..374: note = Synthetic polypeptide
  source 1..374: mol_type = other DNA
tttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacggactgtgagctccttgagggccaggacttatctctgttcgcagtgccaaggacatggcctggaccatagaagatactcagttttttgttgaataaat

SEQ ID NO: 4496 - DNA, 500 bp, synthetic construct
  misc_feature 1..500: note = Synthetic polypeptide
  source 1..500: mol_type = other DNA
ctgatcaggtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacaaatgttgctgaggcacagtgcatcgccaaccaagttcagctcttctacgctactgatcggaaagagacctacggactgtgagctccttgagggccaggacttatctctgttcgcagtgccaaggacatggcctggaccatagaagatactcagttttttgttgaataaat

SEQ ID NO: 4497 - DNA, 509 bp, synthetic construct
  misc_feature 1..509: note = Synthetic polypeptide
  source 1..509: mol_type = other DNA
atggtaaaagaaaaaactgcagaagaaataaaacagatttggcagcaatattttgcagcaaaagatacagtctacgcagttattcctgcagaaaagtttgatttgatctggaaccgggctcagtcctgtccaacatttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacggactgtgagctccttgagggccaggacttatctctgttcgcagtgccaaggacatggcctggaccatagaagatactcagttttttgttgaataaat

SEQ ID NO: 4498 - DNA, 827 bp, synthetic construct
  misc_feature 1..827: note = Synthetic polypeptide
  source 1..827: mol_type = other DNA
atggagcgggcgcgcgggccgcgggccgaggccgacgcgcctgaggaggaggaggaggcgggggcggccatggctgctgtggtggtggcggctgcgggtggcgcgggaccggcggtcctgcaggtggccggtctctaccggggcctgtgcgcggtgcgcagccgcgccctgggcctggggctcgtgtcacccgcgcagctgcgcgtcttcccagtgcgccccggctcgggccggcccgaggggggcgccgacagcagcggggtcggggccgaggccgagctccaggccaaccctttctacgaccgctaccgcgacaagatccagctgctgcgcaggtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacaaatgttgctgaggcacagtgcatcgccaaccaagttcagctcttctacgctactgatcggaaagagacctacggactgtgagctccttgagggccaggacttatctctgttcgcagtgccaaggacatggcctggaccatagaagatactcagttttttgttgaataaat

SEQ ID NO: 4499 - DNA, 526 bp, synthetic construct
  misc_feature 1..526: note = Synthetic polypeptide
  source 1..526: mol_type = other DNA
tggggaaacagtctgtgaacagaggattcactaaggacaagactctcagttcaatctttaacattgagatggtaaaagaaaaaactgcagaagaaataaaacaggcagaaaagtttgatttgatctggaaccgggctcagtcctgtccaacatttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacggactgtgagctccttgagggccaggacttatctctgttcgcagtgccaaggacatggcctggaccatagaagatactcagttttttgttgaataaat

SEQ ID NO: 4500 - DNA, 698 bp, synthetic construct
  misc_feature 1..698: note = Synthetic polypeptide
  source 1..698: mol_type = other DNA
atgtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacatttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacggactgtgagctccttgagggccaggacttatctctgttcgcagtgccaaggacatggcctggaccatagaagatactcagttttttgttgaataaat

SEQ ID NO: 4501 - DNA, 632 bp, synthetic construct
  misc_feature 1..632: note = Synthetic polypeptide
  source 1..632: mol_type = other DNA
atgacacagctgcttctgttccttgtggctctcctggttctgggtcatgtgccatcagccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgccccgccgccatcccgtctaggaagtgaggagcgcctcttcccggcagccatcccatctgggaagtgaggagcgtctctgcccggccgcccatcgtctgagatgtggggagcgcctctgccccgccgccccgtctgggatgtgaggagcgcctctgccaggctgcgaccccgtctgggaggtgaggagcgtctctgcccagccgccccgtctgagaagtgaggagcccctccgcccggcagctgccccgtctgagaagtgaggagcccctctgcccggcagccaccccgtctgggaagtgaggagcgtctccgcccggcagccgccccgtccgggagggaggtggggggatcagcctcctgcccggccagccgccccgtccgggagggaggtgggggggtcagccccccgtccgg

SEQ ID NO: 4502 - DNA, 584 bp, synthetic construct
  misc_feature 1..584: note = Synthetic polypeptide
  source 1..584: mol_type = other DNA
atggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgctgtgaggtatgccttatttgcagttggatgctcagccaccagcccagtgtcttgcacaaagtaggaacttattaaatgtttgttgaataaa

SEQ ID NO: 4503 - DNA, 623 bp, synthetic construct
  misc_feature 1..623: note = Synthetic polypeptide
  source 1..623: mol_type = other DNA
atggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaaggtttgactcctgtttaaagtatggccatcataaaaggggaatcttgtggaagaagaatgaagttgctgattatgaagctacaacattttccatcttctataacaacactctgttcctggtcgtggtcattgttgcttccttcttcatattgaagaacttcaaccccacagtgctgtgaggtatgccttatttgcagttggatgctcagccaccagcccagtgtcttgcacaaagtaggaacttattaaatgtttgttgaataaa

SEQ ID NO: 4504 - DNA, 428 bp, synthetic construct
  misc_feature 1..428: note = Synthetic polypeptide
  source 1..428: mol_type = other DNA
atggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgctgtgaggtatgccttatttgcagttggatgctcagccaccagcccagtgtcttgcacaaagtaggaacttattaaatgtttgttgaataaa

SEQ ID NO: 4505 - DNA, 32605 bp, synthetic construct
  misc_feature 1..32605: note = Synthetic polypeptide
  source 1..32605: mol_type = other DNA
atgctgaaaccctcaggccttcctgggtcatcttctcccacccgctccttgatgacagggagcaggagcactaaagccacaccagaaatggattcaggactgacaggagccaccttgtcacctaagacatctacaggtgcaatcgtggtgacagaacatactctgccctttacttccccagataagaccttggccagtcctacatcttcggttgtgggaagaaccacccagtctttgggggtgatgtcctctgctctccctgagtcaacctctagaggaatgacacactccgagcaaagaaccagcccatcgctgagtccccaggtcaatggaactccctctaggaactaccctgctacaagcatggtttcaggattgagttccccaaggaccaggaccagttccacagaaggaaattttaccaaagaagcatctacatacacactcactgtagagaccacaagtggcccagtcactgagaagtacacagtccccactgagacctcaacaactgaaggtgacagcacagagaccccctgggacacaagatatattcctgtaaaaatcacatctccaatgaaaacatttgcagattcaactgcatccaaggaaaatgccccagtgtctatgactccagctgagaccacagttactgactcacatactccaggaaggacaaacccatcatttgggacactttattcttccttccttgacctatcacctaaagggaccccaaattccagaggtgaaacaagcctggaactgattctatcaaccactggatatcccttctcctctcctgaacctggctctgcaggacacagcagaataagtaccagtgcgcctttgtcatcatctgcttcagttctcgataataaaatatcagagaccagcatattctcaggccagagtctcacctcccctctgtctcctggggtgcccgaggccagagccagcacaatgcccaactcagctatccctttttccatgacactaagcaatgcagaaacaagtgccgaaagggtcagaagcacaatttcctctctggggactccatcaatatccacaaagcagacagcagagactatccttaccttccatgccttcgctgagaccatggatatacccagcacccacatagccaagactttggcttcagaatggttgggaagtccaggtacccttggtggcaccagcacttcagcgctgacaaccacatctccatctaccactttagtctcagaggagaccaacacccatcactccacgagtggaaaggaaacagaaggaactttgaatacatctatgactccacttgagacctctgctcctggagaagagtccgaaatgactgccaccttggtccccactctaggttttacaactcttgacagcaagatcagaagtccatctcaggtctcttcatcccacccaacaagagagctcagaaccacaggcagcacctctgggaggcagagttccagcacagctgcccacgggagctctgacatcctgagggcaaccacttccagcacctcaaaagcatcatcatggaccagtgaaagcacagctcagcaatttagtgaaccccagcacacacagtgggtggagacaagtcctagcatgaaaacagagagacccccagcatcaaccagtgtggcagcccctatcaccacttctgttccctcagtggtctctggcttcaccaccctgaagaccagctccacaaaagggatttggcttgaagaaacatctgcagacacactcatcggagaatccacagctggcccaaccacccatcagtttgctgttcccactgggatttcaatgacaggaggcagcagcaccaggggaagccagggcacaacccacctactcaccagagccacagcatcatctgagacatccgcagatttgactctggccacgaacggtgtcccagtctccgtgtctccagcagtgagcaagacggctgctggctcaagtcctccaggagggacaaagccatcatatacaatggtttcttctgtcatccctgagacatcatctctacagtcctcagctttcagggaaggaaccagcctgggactgactccattaaacactagacatcccttctcttcccctgaaccagactctgcaggacacaccaagataagcaccagcattcctctgttgtcatctgcttcagttcttgaggataaagtgtcagcgaccagcacattctcacaccacaaagccacctcatctattaccacagggactcctgaaatctcaacaaagacaaagcccagctcagccgttctttcctccatgaccctaagcaatgcagcaacaagtcctgaaagagtcagaaatgcaacttcccctctgactcatccatctccatcaggggaagagacagcagggagtgtcctcactctcagcacctctgctgagactacagactcacctaacatccacccaactgggacactgacttcagaatcgtcagagagtcctagcactctcagcctcccaagtgtctctggagtcaaaaccacattttcttcatctactccttccactcatctatttactagtggagaagaaacagaggaaacttcgaatccatctgtgtctcaacctgagacttctgtttccagagtaaggaccaccttggccagcacctctgtccctaccccagtattccccaccatggacacctggcctacacgttcagctcagttctcttcatcccacctagtgagtgagctcagagctacgagcagtacctcagttacaaactcaactggttcagctcttcctaaaatatctcacctcactgggacggcaacaatgtcacagaccaatagagacacgtttaatgactctgctgcaccccaaagcacaacttggccagagactagtcccagattcaagacagggttaccttcagcaacaaccactgtttcaacctctgccacttctctctctgctactgtaatggtctctaaattcacttctccagcaactagttccatggaagcaacttctatcagggaaccatcaacaaccatcctcacaacagagaccacgaatggcccaggctctatggctgtggcttctaccaacatcccaattggaaagggctacattactgaaggaagattggacacaagccatctgcccattggaaccacagcttcctctgagacatctatggattttaccatggccaaagaaagtgtctcaatgtcagtatctccatctcagtccatggatgctgctggctcaagcactccaggaaggacaagccaattcgttgacacattttctgatgatgtctatcatttaacatccagagaaattacaatacctagagatggaacaagctcagctctgactccacaaatgactgcaactcaccctccatctcctgatcctggctctgctagaagcacctggcttggcatcttgtcctcatctccttcttctcctactcccaaagtcacaatgagctccacattttcaactcagagagtcaccacaagcatgataatggacacagttgaaactagtcggtggaacatgcccaacttaccttccacgacttccttgacaccaagtaatattccaacaagtggtgccataggaaaaagcaccctggttcccttggacactccatctccagccacatcattggaggcatcagaagggggacttccaaccctcagcacctaccctgaatcaacaaacacacccagcatccacctcggagcacacgctagttcagaaagtccaagcaccatcaaacttaccatggcttcagtagtaaaacctggctcttacacacctctcaccttcccctcaatagagacccacattcatgtatcaacagccagaatggcttactcttctgggtcttcacctgagatgacagctcctggagagactaacactggtagtacctgggaccccaccacctacatcaccactacggatcctaaggatacaagttcagctcaggtctctacaccccactcagtgaggacactcagaaccacagaaaaccatccaaagacagagtccgccaccccagctgcttactctggaagtcctaaaatctcaagttcacccaatctcaccagtccggccacaaaagcatggaccatcacagacacaactgaacactccactcaattacattacacaaaattggcagaaaaatcatctggatttgagacacagtcagctccaggacctgtctctgtagtaatccctacctcccctaccattggaagcagcacattggaactaacttctgatgtcccaggggaacccctggtccttgctcccagtgagcagaccacaatcactctccccatggcaacatggctgagtaccagtttgacagaggaaatggcttcaacagaccttgatatttcaagtccaagttcacccatgagtacatttgctatttttccacctatgtccacaccttctcatgaactttcaaagtcagaggcagataccagtgccattagaaatacagattcaacaacgttggatcagcacctaggaatcaggagtttgggcagaactggggacttaacaactgttcctatcaccccactgacaaccacgtggaccagtgtgattgaacactcaacacaagcacaggacaccctttctgcaacgatgagtcctactcacgtgacacagtcactcaaagatcaaacatctataccagcctcagcatccccttcccatcttactgaagtctaccctgagctcgggacacaagggagaagctcctctgaggcaaccactttttggaaaccatctacagacacactgtccagagagattgagactggcccaacaaacattcaatccactccacccatggacaacacaacaacagggagcagtagtagtggagtcaccctgggcatagcccaccttcccataggaacatcctccccagctgagacatccacaaacatggcactggaaagaagaagttctacagccactgtctctatggctgggacaatgggactccttgttactagtgctccaggaagaagcatcagccagtcattaggaagagtttcctctgtcctttctgagtcaactactgaaggagtcacagattctagtaagggaagcagcccaaggctgaacacacagggaaatacagctctctcctcctctcttgaacccagctatgctgaaggaagccagatgagcacaagcatccctctaacctcatctcctacaactcctgatgtggaattcatagggggcagcacattttggaccaaggaggtcaccacagttatgacctcagacatctccaagtcttcagcaaggacagagtccagctcagctacccttatgtccacagctttgggaagcactgaaaatacaggaaaagaaaaactcagaactgcctctatggatcttccatctccaactccatcaatggaggtgacaccatggatttctctcactctcagtaatgcccccaataccacagattcacttgacctcagccatggggtgcacaccagctctgcagggactttggccactgacaggtcattgaatactggtgtcactagagcctccagattggaaaacggctctgatacctcttctaagtccctgtctatgggaaacagcactcacacttccatgacttacacagagaagagtgaagtgtcttcttcaatccatccccgacctgagacctcagctcctggagcagagaccactttgacttccactcctggaaacagggccataagcttaacattgcctttttcatccattccagtggaagaagtcatttctacaggcataacctcaggaccagacatcaactcagcacccatgacacattctcccatcaccccaccaacaattgtatggaccagtacaggcacaattgaacagtccactcaaccactacatgcagtttcttcagaaaaagtttctgtgcagacacagtcaactccatatgtcaactctgtggcagtgtctgcttcccctacccatgagaattcagtctcttctggaagcagcacatcctctccatattcctcagcctcacttgaatccttggattccacaatcagtaggaggaatgcaatcacttcctggctatgggacctcactacatctctccccactacaacttggccaagtactagtttatctgaggcactgtcctcaggccattctggggtttcaaacccaagttcaactacgactgaatttccactcttttcagctgcatccacatctgctgctaagcaaagaaatccagaaacagagacccatggtccccagaatacagccgcgagtactttgaacactgatgcatcctcggtcacaggtctttctgagactcctgtgggggcaagtatcagctctgaagtccctcttccaatggccataacttctagatcagatgtttctggccttacatctgagagtactgctaacccgagtttaggcacagcctcttcagcagggaccaaattaactaggacaatatccctgcccacttcagagtctttggtttcctttagaatgaacaaggatccatggacagtgtcaatccctttggggtcccatccaactactaatacagaaacaagcatcccagtaaacagcgcaggtccacctggcttgtccacagtagcatcagatgtaattgacacaccttcagatggggctgagagtattcccactgtctccttttccccctcccctgatactgaagtgacaactatctcacatttcccagaaaagacaactcattcatttagaaccatttcatctctcactcatgagttgacttcaagagtgacacctattcctggggattggatgagttcagctatgtctacaaagcccacaggagccagtccctccattacactgggagagagaaggacaatcacctctgctgctccaaccacttcccccatagttctcactgctagtttcacagagaccagcacagtttcactggataatgaaactacagtaaaaacctcagatatccttgacgcacggaaaacaaatgagctcccctcagatagcagttcttcttctgatctgatcaacacctccatagcttcttcaactatggatgtcactaaaacagcctccatcagtcccactagcatctcaggaatgacagcaagttcctccccatctctcttctcttcagatagaccccaggttcccacatctacaacagagacaaatacagccacctctccatctgtttccagtaacacctattctcttgatgggggctccaatgtgggtggcactccatccactttaccaccctttacaatcacccaccctgtcgagacaagctcggccctattagcctggtctagaccagtaagaactttcagcaccatggtcagcactgacactgcctccggagaaaatcctacctctagcaattctgtggtgacttctgttccagcaccaggtacatggaccagtgtaggcagtactactgacttacctgccatgggctttctcaagacaagtcctgcaggagaggcacactcacttctagcatcaactattgaaccagccactgccttcactccccatctctcagcagcagtggtcactggatccagtgctacatcagaagccagtcttctcactacgagtgaaagcaaagccattcattcttcaccacagaccccaactacacccacctctggagcaaactgggaaacttcagctactcctgagagccttttggtagtcactgagacttcagacacaacacttacctcaaagattttggtcacagataccatcttgttttcaactgtgtccacgccaccttctaaatttccaagtacggggactctgtctggagcttccttccctactttactcccggacactccagccatccctctcactgccactgagccaacaagttcattagctacatcctttgattccaccccactggtgactatagcttcggatagtcttggcacagtcccagagactaccctgaccatgtcagagacctcaaatggtgatgcactggttcttaagacagtaagtaacccagataggagcatccctggaatcactatccaaggagtaacagaaagtccactccatccttcttccacttccccctctaagattgttgctccacggaatacaacctatgaaggttcgatcacagtggcactttctactttgcctgcgggaactactggttcccttgtattcagtcagagttctgaaaactcagagacaacggctttggtagactcatcagctgggcttgagagggcatctgtgatgccactaaccacaggaagccagggtatggctagctctggaggaatcagaagtgggtccactcactcaactggaaccaaaacattttcttctctccctctgaccatgaacccaggtgaggttacagccatgtctgaaatcaccacgaacagactgacagctactcaatcaacagcacccaaagggatacctgtgaagcccaccagtgctgagtcaggcctcctaacacctgtctctgcctcctcaagcccatcaaaggcctttgcctcactgactacagctcccccaacttgggggatcccacagtctaccttgacatttgagttttctgaggtcccaagtttggatactaagtccgcttctttaccaactcctggacagtccctgaacaccattccagactcagatgcaagcacagcatcttcctcactgtccaagtctccagaaaaaaacccaagggcaaggatgatgacttccacaaaggccataagtgcaagctcatttcaatcaacaggttttactgaaacccctgagggatctgcctccccttctatggcagggcatgaacccagagtccccacttcaggaacaggggaccctagatatgcctcagagagcatgtcttatccagacccaagcaaggcatcatcagctatgacatcgacctctcttgcatcaaaactcacaactctcttcagcacaggtcaagcagcaaggtctggttctagttcctctcccataagcctatccactgagaaagaaacaagcttcctttcccccactgcatccacctccagaaagacttcactatttcttgggccttccatggcaaggcagcccaacatattggtgcatcttcagacttcagctctgacactttctccaacatccactctaaatatgtcccaggaggagcctcctgagttaacctcaagccagaccattgcagaagaagagggaacaacagctgaaacacagacgttaaccttcacaccatctgagaccccaacatccttgttacctgtctcttctcccacagaacccacagccagaagaaagagttctccagaaacatgggcaagctctatttcagttcctgccaagacctccttggttgaaacaactgatggaacgctagtgaccaccataaagatgtcaagccaggcagcacaaggaaattccacgtggcctgccccagcagaggagacggggagcagtccagcaggcacatccccaggaagcccagaaatgtctaccactctcaaaatcatgagctccaaggaacccagcatcagcccagagatcaggtccactgtgagaaattctccttggaagactccagaaacaactgttcccatggagaccacagtggaaccagtcacccttcagtccacagccctaggaagtggcagcaccagcatctctcacctgcccacaggaaccacatcaccaaccaagtcaccaacagaaaatatgttggctacagaaagggtctccctctccccatccccacctgaggcttggaccaacctttattctggaactccaggagggaccaggcagtcactggccacaatgtcctctgtctccctagagtcaccaactgctagaagcatcacagggactggtcagcaaagcagtccagaactggtttcaaagacaactggaatggaattctctatgtggcatggctctactggagggaccacaggggacacacatgtctctctgagcacatcttccaatatccttgaagaccctgtaaccagcccaaactctgtgagctcattgacagataaatccaaacataaaaccgagacatgggtaagcaccacagccattccctccactgtcctgaataataagataatggcagctgaacaacagacaagtcgatctgtggatgaggcttattcatcaactagttcttggtcagatcagacatctgggagtgacatcacccttggtgcatctcctgatgtcacaaacacattatacatcacctccacagcacaaaccacctcactagtgtctctgccctctggagaccaaggcattacaagcctcaccaatccctcaggaggaaaaacaagctctgcgtcatctgtcacatctccttcaatagggcttgagactctgagggccaatgtaagtgcagtgaaaagtgacattgcccctactgctgggcatctatctcagacttcatctcctgcggaagtgagcatcctggacgtaaccacagctcctactccaggtatctccaccaccatcaccaccatgggaaccaactcaatctcaactaccacacccaacccagaagtgggtatgagtaccatggacagcaccccggccacagagaggcgcacaacttctacagaacacccttccacctggtcttccacagctgcatcagattcctggactgtcacagacatgacttcaaacttgaaagttgcaagatctcctggaacaatttccacaatgcatacaacttcattcttagcctcaagcactgaattagactccatgtctactccccatggccgtataactgtcattggaaccagcctggtcactccatcctctgatgcttcagctgtaaagacagagaccagtacaagtgaaagaacattgagtccttcagacacaactgcatctactcccatctcaactttttctcgtgtccagaggatgagcatctcagttcctgacattttaagtacaagttggactcccagtagtacagaagcagaagatgtgcctgtttcaatggtttctacagatcatgctagtacaaagactgacccaaatacgcccctgtccacttttctgtttgattctctgtccactcttgactgggacactgggagatctctgtcatcagccacagccactacctcagctcctcagggggccacaactccccaggaactcactttggaaaccatgatcagcccagctacctcacagttgcccttctctatagggcacattacaagtgcagtcacaccagctgcaatggcaaggagctctggagttactttttcaagaccagatcccacaagcaaaaaggcagagcagacttccactcagcttcccaccaccacttctgcacatccagggcaggtgcccagatcagcagcaacaactctggatgtgatcccacacacagcaaaaactccagatgcaacttttcagagacaagggcagacagctcttacaacagaggcaagagctacatctgactcctggaatgagaaagaaaaatcaaccccaagtgcaccttggatcactgagatgatgaattctgtctcagaagataccatcaaggaggttaccagctcctccagtgtattaaggaccctgaatacgctggacataaacttggaatctgggacgacttcatccccaagttggaaaagcagcccatatgagagaattgccccttctgagtccaccacagacaaagaggcaattcacccttctacaaacacagtagagaccacaggctgggtcacaagttccgaacatgcttctcattccactatcccagcccactcagcgtcatccaaactcacatctccagtggttacaacctccaccagggaacaagcaatagtttctatgtcaacaaccacatggccagagtctacaagggctagaacagagcctaattccttcttgactattgaactgagggacgtcagcccttacatggacaccagctcaaccacacaaacaagtattatctcttccccaggttccactgcgatcaccaaggggcctagaacagaaattacctcctctaagagaatatccagctcattccttgcccagtctatgaggtcgtcagacagcccctcagaagccatcaccaggctgtctaactttcctgccatgacagaatctggaggaatgatccttgctatgcaaacaagtccacctggcgctacatcactaagtgcacctactttggatacatcagccacagcctcctggacagggactccactggctacgactcagagatttacatactcagagaagaccactctctttagcaaaggtcctgaggatacatcacagccaagccctccctctgtggaagaaaccagctcttcctcttccctggtacctatccatgctacaacctcgccttccaatattttgttgacatcacaagggcacagtccctcctctactccacctgtgacctcagttttcttgtctgagacctctggcctggggaagaccacagacatgtcgaggataagcttggaacctggcacaagtttacctcccaatttgagcagtacagcaggtgaggcgttatccacttatgaagcctccagagatacaaaggcaattcatcattctgcagacacagcagtgacgaatatggaggcaaccagttctgaatattctcctatcccaggccatacaaagccatccaaagccacatctccattggttacctcccacatcatgggggacatcacttcttccacatcagtatttggctcctccgagaccacagagattgagacagtgtcctctgtgaaccagggacttcaggagagaagcacatcccaggtggccagctctgctacagagacaagcactgtcattacccatgtgtctagtggtgatgctactactcatgtcaccaagacacaagccactttctctagcggaacatccatctcaagccctcatcagtttataacttctaccaacacatttacagatgtgagcaccaacccctccacctctctgataatgacagaatcttcaggagtgaccatcaccacccaaacaggtcctactggagctgcaacacagggtccatatctcttggacacatcaaccatgccttacttgacagagactccattagctgtgactccagattttatgcaatcagagaagaccactctcataagcaaaggtcccaaggatgtgtcctggacaagccctccctctgtggcagaaaccagctatccctcttccctgacacctttcttggtcacaaccatacctcctgccacttccacgttacaagggcaacatacatcctctcctgtttctgcgacttcagttcttacctctggactggtgaagaccacagatatgttgaacacaagcatggaacctgtgaccaattcacctcaaaatttgaacaatccatcaaatgagatactggccactttggcagccaccacagatatagagactattcatccttccataaacaaagcagtgaccaatatggggactgccagttcagcacatgtactgcattccactctcccagtcagctcagaaccatctacagccacatctccaatggttcctgcctccagcatgggggacgctcttgcttctatatcaatacctggttctgagaccacagacattgagggagagccaacatcctccctgactgctggacgaaaagagaacagcaccctccaggagatgaactcaactacagagtcaaacatcatcctctccaatgtgtctgtgggggctattactgaagccacaaaaatggaagtcccctcttttgatgcaacattcataccaactcctgctcagtcaacaaagttcccagatattttctcagtagccagcagtagactttcaaactctcctcccatgacaatatctacccacatgaccaccacccagacagggtcttctggagctacatcaaagattccacttgccttagacacatcaaccttggaaacctcagcagggactccatcagtggtgactgaggggtttgcccactcaaaaataaccactgcaatgaacaatgatgtcaaggacgtgtcacagacaaaccctccctttcaggatgaagccagctctccctcttctcaagcacctgtccttgtcacaaccttaccttcttctgttgctttcacaccgcaatggcacagtacctcctctcctgtttctatgtcctcagttcttacttcttcactggtaaagaccgcaggcaaggtggatacaagcttagaaacagtgaccagttcacctcaaagtatgagcaacactttggatgacatatcggtcacttcagcagccaccacagatatagagacaacgcatccttccataaacacagtagttaccaatgtggggaccaccggttcagcatttgaatcacattctactgtctcagcttacccagagccatctaaagtcacatctccaaatgttaccacctccaccatggaagacaccacaatttccagatcaatacctaaatcctctaagactacaagaactgagactgagacaacttcctccctgactcctaaactgagggagaccagcatctcccaggagatcacctcgtccacagagacaagcactgttccttacaaagagctcactggtgccactaccgaggtatccaggacagatgtcacttcctctagcagtacatccttccctggccctgatcagtccacagtgtcactagacatctccacagaaaccaacaccaggctgtctacctccccaataatgacagaatctgcagaaataaccatcaccacccaaacaggtcctcatggggctacatcacaggatacttttaccatggacccatcaaatacaaccccccaggcagggatccactcagctatgactcatggattttcacaattggatgtgaccactcttatgagcagaattccacaggatgtatcatggacaagtcctccctctgtggataaaaccagctccccctcttcctttctgtcctcacctgcaatgaccacaccttccctgatttcttctaccttaccagaggataagctctcctctcctatgacttcacttctcacctctggcctagtgaagattacagacatattacgtacacgcttggaacctgtgaccagctcacttccaaatttcagcagcacctcagataagatactggccacttctaaagacagtaaagacacaaaggaaatttttccttctataaacacagaagagaccaatgtgaaagccaacaactctggacatgaatcccattcccctgcactggctgactcagagacacccaaagccacaactcaaatggttatcaccaccactgtgggagatccagctccttccacatcaatgccagtgcatggttcctctgagactacaaacattaagagagagccaacatatttcttgactcctagactgagagagaccagtacctctcaggagtccagctttcccacggacacaagttttctactttccaaagtccccactggtactattactgaggtctccagtacaggggtcaactcttctagcaaaatttccaccccagaccatgataagtccacagtgccacctgacaccttcacaggagagatccccagggtcttcacctcctctattaagacaaaatctgcagaaatgacgatcaccacccaagcaagtcctcctgagtctgcatcgcacagtacccttcccttggacacatcaaccacactttcccagggagggactcattcaactgtgactcagggattcccatactcagaggtgaccactctcatgggcatgggtcctgggaatgtgtcatggatgacaactccccctgtggaagaaaccagctctgtgtcttccctgatgtcttcacctgccatgacatccccttctcctgtttcctccacatcaccacagagcatcccctcctctcctcttcctgtgactgcacttcctacttctgttctggtgacaaccacagatgtgttgggcacaacaagcccagagtctgtaaccagttcacctccaaatttgagcagcatcactcatgagagaccggccacttacaaagacactgcacacacagaagccgccatgcatcattccacaaacaccgcagtgaccaatgtagggacttccgggtctggacataaatcacaatcctctgtcctagctgactcagagacatcgaaagccacacctctgatgagtaccacctccaccctgggggacacaagtgtttccacatcaactcctaatatctctcagactaaccaaattcaaacagagccaacagcatccctgagccctagactgagggagagcagcacgtctgagaagaccagctcaacaacagagacaaatactgccttttcttatgtgcccacaggtgctattactcaggcctccagaacagaaatctcctctagcagaacatccatctcagaccttgatcggcccacaatagcacccgacatctccacaggaatgatcaccaggctcttcacctcccccatcatgacaaaatctgcagaaatgaccgtcaccactcaaacaactactcctggggctacatcacagggtatccttccctgggacacatcaaccacacttttccagggagggactcattcaaccgtgtctcagggattcccacactcagagataaccactcttcggagcagaacccctggagatgtgtcatggatgacaactccccctgtggaagaaaccagctctgggttttccctgatgtcaccttccatgacatccccttctcctgtttcctccacatcaccagagagcatcccctcctctcctctccctgtgactgcacttcttacttctgttctggtgacaaccacaaatgtattgggcacaacaagcccagagcccgtaacgagttcacctccaaatttaagcagccccacacaggagagactgaccacttacaaagacactgcgcacacagaagccatgcatgcttccatgcatacaaacactgcagtggccaacgtggggacctccatttctggacatgaatcacaatcttctgtcccagctgattcacacacatccaaagccacatctccaatgggtatcaccttcgccatgggggatacaagtgtttctacatcaactcctgccttctttgagactagaattcagactgaatcaacatcctctttgattcctggattaagggacaccaggacgtctgaggagatcaacactgtgacagagaccagcactgtcctttcagaagtgcccactactactactactgaggtctccaggacagaagttatcacttccagcagaacaaccatctcagggcctgatcattccaaaatgtcaccctacatctccacagaaaccatcaccaggctctccacttttccttttgtaacaggatccacagaaatggccatcaccaaccaaacaggtcctatagggactatctcacaggctacccttaccctggacacatcaagcacagcttcctgggaagggactcactcacctgtgactcagagatttccacactcagaggagaccactactatgagcagaagtactaagggcgtgtcatggcaaagccctccctctgtggaagaaaccagttctccttcttccccagtgcctttacctgcaataacctcacattcatctctttattccgcagtatcaggaagtagccccacttctgctctccctgtgacttcccttctcacctctggcaggaggaagaccatagacatgttggacacacactcagaacttgtgaccagctccttaccaagtgcaagtagcttctcaggtgagatactcacttctgaagcctccacaaatacagagacaattcacttttcagagaacacagcagaaaccaatatggggaccaccaattctatgcataaactacattcctctgtctcaatccactcccagccatccggacacacacctccaaaggttactggatctatgatggaggacgctattgtttccacatcaacacctggttctcctgagactaaaaatgttgacagagactcaacatcccctctgactcctgaactgaaagaggacagcaccgccctggtgatgaactcaactacagagtcaaacactgttttctccagtgtgtccctggatgctgctactgaggtctccagggcagaagtcacctactatgatcctacattcatgccagcttctgctcagtcaacaaagtccccagacatttcacctgaagccagcagcagtcattctaactctcctcccttgacaatatctacacacaagaccatcgccacacaaacaggtccttctggggtgacatctcttggccaactgaccctggacacatcaaccatagccacctcagcaggaactccatcagccagaactcaggattttgtagattcagaaacaaccagtgtcatgaacaatgatctcaatgatgtgttgaagacaagccctttctctgcagaagaagccaactctctctcttctcaggcacctctccttgtgacaacctcaccttctcctgtaacttccacattgcaagagcacagtacctcctctcttgtttctgtgacctcagtacccacccctacactggcgaagatcacagacatggacacaaacttagaacctgtgactcgttcacctcaaaatttaaggaacaccttggccacttcagaagccaccacagatacacacacaatgcatccttctataaacacagcagtggccaatgtggggaccaccagttcaccaaatgaattctattttactgtctcacctgactcagacccatataaagccacatccgcagtagttatcacttccacctcgggggactcaatagtttccacatcaatgcctagatcctctgcgatgaaaaagattgagtctgagacaactttctccctgatatttagactgagggagactagcacctcccagaaaattggctcatcctcagacacaagcacggtctttgacaaagcattcactgctgctactactgaggtctccagaacagaactcacctcctctagcagaacatccatccaaggcactgaaaagcccacaatgtcaccggacacctccacaagatctgtcaccatgctttctacttttgctggcctgacaaaatccgaagaaaggaccattgccacccaaacaggtcctcatagggcgacatcacagggtacccttacctgggacacatcaatcacaacctcacaggcagggacccactcagctatgactcatggattttcacaattagatttgtccactcttacgagtagagttcctgagtacatatcagggacaagcccaccctctgtggaaaaaaccagctcttcctcttcccttctgtctttaccagcaataacctcaccgtcccctgtacctactacattaccagaaagtaggccgtcttctcctgttcatctgacttcactccccacctctggcctagtgaagaccacagatatgctggcatctgtggccagtttacctccaaacttgggcagcacctcacataagataccgactacttcagaagacattaaagatacagagaaaatgtatccttccacaaacatagcagtaaccaatgtggggaccaccacttctgaaaaggaatcttattcgtctgtcccagcctactcagaaccacccaaagtcacctctccaatggttacctctttcaacataagggacaccattgtttccacatccatgcctggctcctctgagattacaaggattgagatggagtcaacattctccctggctcatgggctgaagggaaccagcacctcccaggaccccatcgtatccacagagaaaagtgctgtccttcacaagttgaccactggtgctactgagacctctaggacagaagttgcctcttctagaagaacatccattccaggccctgatcattccacagagtcaccagacatctccactgaagtgatccccagcctgcctatctcccttggcattacagaatcttcaaatatgaccatcatcactcgaacaggtcctcctcttggctctacatcacagggcacatttaccttggacacaccaactacatcctccagggcaggaacacactcgatggcgactcaggaatttccacactcagaaatgaccactgtcatgaacaaggaccctgagattctatcatggacaatccctccttctatagagaaaaccagcttctcctcttccctgatgccttcaccagccatgacttcacctcctgtttcctcaacattaccaaagaccattcacaccactccttctcctatgacctcactgctcacccctagcctagtgatgaccacagacacattgggcacaagcccagaacctacaaccagttcacctccaaatttgagcagtacctcacatgagatactgacaacagatgaagacaccacagctatagaagccatgcatccttccacaagcacagcagcgactaatgtggaaaccaccagttctggacatgggtcacaatcctctgtcctagctgactcagaaaaaaccaaggccacagctccaatggataccacctccaccatggggcatacaactgtttccacatcaatgtctgtttcctctgagactacaaaaattaagagagagtcaacatattccttgactcctggactgagagagaccagcatttcccaaaatgccagcttttccactgacacaagtattgttctttcagaagtccccactggtactactgctgaggtctccaggacagaagtcacctcctctggtagaacatccatccctggcccttctcagtccacagttttgccagaaatatccacaagaacaatgacaaggctctttgcctcgcccaccatgacagaatcagcagaaatgaccatccccactcaaacaggtccttctgggtctacctcacaggatacccttaccttggacacatccaccacaaagtcccaggcaaagactcattcaactttgactcagagatttccacactcagagatgaccactctcatgagcagaggtcctggagatatgtcatggcaaagctctccctctctggaaaatcccagctctctcccttccctgctgtctttacctgccacaacctcacctcctcccatttcctccacattaccagtgactatctcctcctctcctcttcctgtgacttcacttctcacctctagcccggtaacgaccacagacatgttacacacaagcccagaacttgtaaccagttcacctccaaagctgagccacacttcagatgagagactgaccactggcaaggacaccacaaatacagaagctgtgcatccttccacaaacacagcagcgtccaatgtggagattcccagctctggacatgaatccccttcctctgccttagctgactcagagacatccaaagccacatcaccaatgtttattacctccacccaggaggatacaactgttgccatatcaacccctcacttcttggagactagcagaattcagaaagagtcaatttcctccctgagccctaaattgagggagacaggcagttctgtggagacaagctcagccatagagacaagtgctgtcctttctgaagtgtccattggtgctactactgagatctccaggacagaagtcacctcctctagcagaacatccatctctggttctgctgagtccacaatgttgccagaaatatccaccacaagaaaaatcattaagttccctacttcccccatcctggcagaatcatcagaaatgaccatcaagacccaaacaagtcctcctgggtctacatcagagagtacctttacattagacacatcaaccactccctccttggtaataacccattcgactatgactcagagattgccacactcagagataaccactcttgtgagtagaggtgctggggatgtgccacggcccagctctctccctgtggaagaaacaagccctccatcttcccagctgtctttatctgccatgatctcaccttctcctgtttcttccacattaccagcaagtagccactcctcttctgcttctgtgacttcacttctcacaccaggccaagtgaagactactgaggtgttggacgcaagtgcagaacctgaaaccagttcacctccaagtttgagcagcacctcagttgaaatactggccacctctgaagtcaccacagatacggagaaaattcatcctttctcaaacacggcagtaaccaaagttggaacttccagttctggacatgaatccccttcctctgtcctacctgactcagagacaaccaaagccacatcggcaatgggtaccatctccattatgggggatacaagtgtttctacattaactcctgccttatctaacactaggaaaattcagtcagagccagcttcctcactgaccaccagattgagggagaccagcacctctgaagagaccagcttagccacagaagcaaacactgttctttctaaagtgtccactggtgctactactgaggtctccaggacagaagccatctcctttagcagaacatccatgtcaggccctgagcagtccacaatgtcacaagacatctccataggaaccatccccaggatttctgcctcctctgtcctgacagaatctgcaaaaatgaccatcacaacccaaacaggtccttcggagtctacactagaaagtacccttaatttgaacacagcaaccacaccctcttgggtggaaacccactctatagtaattcagggatttccacacccagagatgaccacttccatgggcagaggtcctggaggtgtgtcatggcctagccctccctttgtgaaagaaaccagccctccatcctccccgctgtctttacctgccgtgacctcacctcatcctgtttccaccacattcctagcacatatccccccctctccccttcctgtgacttcacttctcacctctggcccggcgacaaccacagatatcttgggtacaagcacagaacctggaaccagttcatcttcaagtttgagcaccacctcccatgagagactgaccacttacaaagacactgcacatacagaagccgtgcatccttccacaaacacaggagggaccaatgtggcaaccaccagctctggatataaatcacagtcctctgtcctagctgactcatctccaatgtgtaccacctccaccatgggggatacaagtgttctcacatcaactcctgccttccttgagactaggaggattcagacagagctagcttcctccctgacccctggattgagggagtccagcggctctgaagggaccagctcaggcaccaagatgagcactgtcctctctaaagtgcccactggtgctactactgagatctccaaggaagacgtcacctccatcccaggtcccgctcaatccacaatatcaccagacatctccacaagaaccgtcagctggttctctacatcccctgtcatgacagaatcagcagaaataaccatgaacacccatacaagtcctttaggggccacaacacaaggcaccagtactttggacacgtcaagcacaacctctttgacaatgacacactcaactatatctcaaggattttcacactcacagatgagcactcttatgaggaggggtcctgaggatgtatcatggatgagccctccccttctggaaaaaactagaccttccttttctctgatgtcttcaccagccacaacttcaccttctcctgtttcctccacattaccagagagcatctcttcctctcctcttcctgtgacttcactcctcacgtctggcttggcaaaaactacagatatgttgcacaaaagctcagaacctgtaaccaactcacctgcaaatttgagcagcacctcagttgaaatactggccacctctgaagtcaccacagatacagagaaaactcatccttcttcaaacagaacagtgaccgatgtggggacctccagttctggacatgaatccacttcctttgtcctagctgactcacagacatccaaagtcacatctccaatggttattacctccaccatggaggatacgagtgtctccacatcaactcctggcttttttgagactagcagaattcagacagaaccaacatcctccctgacccttggactgagaaagaccagcagctctgaggggaccagcttagccacagagatgagcactgtcctttctggagtgcccactggtgccactgctgaagtctccaggacagaagtcacctcctctagcagaacatccatctcaggctttgctcagctcacagtgtcaccagagacttccacagaaaccatcaccagactccctacctccagcataatgacagaatcagcagaaatgatgatcaagacacaaacagatcctcctgggtctacaccagagagtactcatactgtggacatatcaacaacacccaactgggtagaaacccactcgactgtgactcagagattttcacactcagagatgaccactcttgtgagcagaagccctggtgatatgttatggcctagtcaatcctctgtggaagaaaccagctctgcctcttccctgctgtctctgcctgccacgacctcaccttctcctgtttcctctacattagtagaggatttcccttccgcttctcttcctgtgacttctcttctcaaccctggcctggtgataaccacagacaggatgggcataagcagagaacctggaaccagttccacttcaaatttgagcagcacctcccatgagagactgaccactttggaagacactgtagatacagaagacatgcagccttccacacacacagcagtgaccaacgtgaggacctccatttctggacatgaatcacaatcttctgtcctatctgactcagagacacccaaagccacatctccaatgggtaccacctacaccatgggggaaacgagtgtttccatatccacttctgacttctttgagaccagcagaattcagatagaaccaacatcctccctgacttctggattgagggagaccagcagctctgagaggatcagctcagccacagagggaagcactgtcctttctgaagtgcccagtggtgctaccactgaggtctccaggacagaagtgatatcctctaggggaacatccatgtcagggcctgatcagttcaccatatcaccagacatctctactgaagcgatcaccaggctttctacttcccccattatgacagaatcagcagaaagtgccatcactattgagacaggttctcctggggctacatcagagggtaccctcaccttggacacctcaacaacaaccttttggtcagggacccactcaactgcatctccaggattttcacactcagagatgaccactcttatgagtagaactcctggagatgtgccatggccgagccttccctctgtggaagaagccagctctgtctcttcctcactgtcttcacctgccatgacctcaacttcttttttctccacattaccagagagcatctcctcctctcctcatcctgtgactgcacttctcacccttggcccagtgaagaccacagacatgttgcgcacaagctcagaacctgaaaccagttcacctccaaatttgagcagcacctcagctgaaatattagccacgtctgaagtcaccaaagatagagagaaaattcatccctcctcaaacacacctgtagtcaatgtagggactgtgatttataaacatctatccccttcctctgttttggctgacttagtgacaacaaaacccacatctccaatggctaccacctccactctggggaatacaagtgtttccacatcaactcctgccttcccagaaactatgatgacacagccaacttcctccctgacttctggattaagggagatcagtacctctcaagagaccagctcagcaacagagagaagtgcttctctttctggaatgcccactggtgctactactaaggtctccagaacagaagccctctccttaggcagaacatccaccccaggtcctgctcaatccacaatatcaccagaaatctccacggaaaccatcactagaatttctactcccctcaccacgacaggatcagcagaaatgaccatcacccccaaaacaggtcattctggggcatcctcacaaggtacctttaccttggacacatcaagcagagcctcctggccaggaactcactcagctgcaactcacagatctccacactcagggatgaccactcctatgagcagaggtcctgaggatgtgtcatggccaagccgcccatcagtggaaaaaactagccctccatcttccctggtgtctttatctgcagtaacctcaccttcgccactttattccacaccatctgagagtagccactcatctcctctccgggtgacttctcttttcacccctgtcatgatgaagaccacagacatgttggacacaagcttggaacctgtgaccacttcacctcccagtatgaatatcacctcagatgagagtctggccacttctaaagccaccatggagacagaggcaattcagctttcagaaaacacagctgtgactcagatgggcaccatcagcgctagacaagaattctattcctcttatccaggcctcccagagccatccaaagtgacatctccagtggtcacctcttccaccataaaagacattgtttctacaaccatacctgcttcctctgagataacaagaattgagatggagtcaacatccaccctgacccccacaccaagggagaccagcacctcccaggagatccactcagccacaaagccaagcactgttccttacaaggcactcactagtgccacgattgaggactccatgacacaagtcatgtcctctagcagaggacctagccctgatcagtccacaatgtcacaagacatatccactgaagtgatcaccaggctctctacctcccccatcaagacagaatctacagaaatgaccattaccacccaaacaggttctcctggggctacatcaaggggtacccttaccttggacacttcaacaacttttatgtcagggacccactcaactgcatctcaaggattttcacactcacagatgaccgctcttatgagtagaactcctggagatgtgccatggctaagccatccctctgtggaagaagccagctctgcctctttctcactgtcttcacctgtcatgacctcatcttctcccgtttcttccacattaccagacagcatccactcttcttcgcttcctgtgacatcacttctcacctcagggctggtgaagaccacagagctgttgggcacaagctcagaacctgaaaccagttcacccccaaatttgagcagcacctcagctgaaatactggccatcactgaagtcactacagatacagagaaactggagatgaccaatgtggtaacctcaggttatacacatgaatctccttcctctgtcctagctgactcagtgacaacaaaggccacatcttcaatgggtatcacctaccccacaggagatacaaatgttctcacatcaacccctgccttctctgacaccagtaggattcaaacaaagtcaaagctctcactgactcctgggttgatggagaccagcatctctgaagagaccagctctgccacagaaaaaagcactgtcctttctagtgtgcccactggtgctactactgaggtctccaggacagaagccatctcttctagcagaacatccatcccaggccctgctcaatccacaatgtcatcagacacctccatggaaaccatcactagaatttctacccccctcacaaggaaagaatcaacagacatggccatcacccccaaaacaggtccttctggggctacctcgcagggtacctttaccttggactcatcaagcacagcctcctggccaggaactcactcagctacaactcagagatttccacagtcagtggtgacaactcctatgagcagaggtcctgaggatgtgtcatggccaagcccgctgtctgtggaaaaaaacagccctccatcttccctggtatcttcatcttcagtaacctcaccttcgccactttattccacaccatctgggagtagccactcctctcctgtccctgtcacttctcttttcacctctatcatgatgaaggccacagacatgttggatgcaagtttggaacctgagaccacttcagctcccaatatgaatatcacctcagatgagagtctggccgcttctaaagccaccacggagacagaggcaattcacgtttttgaaaatacagcagcgtcccatgtggaaaccaccagtgctacagaggaactctattcctcttccccaggcttctcagagccaacaaaagtgatatctccagtggtcacctcttcctctataagagacaacatggtttccacaacaatgcctggctcctctggcattacaaggattgagatagagtcaatgtcatctctgacccctggactgagggagaccagaacctcccaggacatcacctcatccacagagacaagcactgtcctttacaagatgccctctggtgccactcctgaggtctccaggacagaagttatgccctctagcagaacatccattcctggccctgctcagtccacaatgtcactagacatctccgatgaagttgtcaccaggctgtctacctctcccatcatgacagaatctgcagaaataaccatcaccacccaaacaggttattctctggctacatcccaggttacccttcccttgggcacctcaatgacctttttgtcagggacccactcaactatgtctcaaggactttcacactcagagatgaccaatcttatgagcaggggtcctgaaagtctgtcatggacgagccctcgctttgtggaaacaactagatcttcctcttctctgacatcattacctctcacgacctcactttctcctgtgtcctccacattactagacagtagcccctcctctcctcttcctgtgacttcacttatcctcccaggcctggtgaagactacagaagtgttggatacaagctcagagcctaaaaccagttcatctccaaatttgagcagcacctcagttgaaataccggccacctctgaaatcatgacagatacagagaaaattcatccttcctcaaacacagcggtggccaaagtgaggacctccagttctgttcatgaatctcattcctctgtcctagctgactcagaaacaaccataaccataccttcaatgggtatcacctccgctgtggacgataccactgttttcacatcaaatcctgccttctctgagactaggaggattccgacagagccaacattctcattgactcctggattcagggagactagcacctctgaagagaccacctcaatcacagaaacaagtgcagtcctttatggagtgcccactagtgctactactgaagtctccatgacagaaatcatgtcctctaatagaatacacatccctgactctgatcagtccacgatgtctccagacatcatcactgaagtgatcaccaggctctcttcctcatccatgatgtcagaatcaacacaaatgaccatcaccacccaaaaaagttctcctggggctacagcacagagtactcttaccttggccacaacaacagcccccttggcaaggacccactcaactgttcctcctagatttttacactcagagatgacaactcttatgagtaggagtcctgaaaatccatcatggaagagctctctctttgtggaaaaaactagctcttcatcttctctgttgtccttacctgtcacgacctcaccttctgtttcttccacattaccgcagagtatcccttcctcctctttttctgtgacttcactcctcaccccaggcatggtgaagactacagacacaagcacagaacctggaaccagtttatctccaaatctgagtggcacctcagttgaaatactggctgcctctgaagtcaccacagatacagagaaaattcatccttcttcaagcatggcagtgaccaatgtgggaaccaccagttctggacatgaactatattcctctgtttcaatccactcggagccatccaaggctacatacccagtgggtactccctcttccatggctgaaacctctatttccacatcaatgcctgctaattttgagaccacaggatttgaggctgagccattttctcatttgacttctggatttaggaagacaaacatgtccctggacaccagctcagtcacaccaacaaatacaccttcttctcctgggtccactcaccttttacagagttccaagactgatttcacctcttctgcaaaaacatcatccccagactggcctccagcctcacagtatactgaaattccagtggacataatcaccccctttaatgcttctccatctattacggagtccactgggataacctccttcccagaatccaggtttactatgtctgtaacagaaagtactcatcatctgagtacagatttgctgccttcagctgagactatttccactggcacagtgatgccttctctatcagaggccatgacttcatttgccaccactggagttccacgagccatctcaggttcaggtagtccattctctaggacagagtcaggccctggggatgctactctgtccaccattgcagagagcctgccttcatccactcctgtgccattctcctcttcaaccttcactaccactgattcttcaaccatcccagccctccatgagataacttcctcttcagctaccccatatagagtggacaccagtcttgggacagagagcagcactactgaaggacgcttggttatggtcagtactttggacacttcaagccaaccaggcaggacatcttcatcacccattttggataccagaatgacagagagcgttgagctgggaacagtgacaagtgcttatcaagttccttcactctcaacacggttgacaagaactgatggcattatggaacacatcacaaaaatacccaatgaagcagcacacagaggtaccataagaccagtcaaaggccctcagacatccacttcgcctgccagtcctaaaggactacacacaggagggacaaaaagaatggagaccaccaccacagctctgaagaccaccaccacagctctgaagaccacttccagagccaccttgaccaccagtgtctatactcccactttgggaacactgactcccctcaatgcatcaatgcaaatggccagcacaatccccacagaaatgatgatcacaaccccatatgttttccctgatgttccagaaacgacatcctcattggctaccagcctgggagcagaaaccagcacagctcttcccaggacaaccccatctgttttcaatagagaatcagagaccacagcctcactggtctctcgttctggggcagagagaagtccggttattcaaactctagatgtttcttctagtgagccagatacaacagcttcatgggttatccatcctgcagagaccatcccaactgtttccaagacaacccccaattttttccacagtgaattagacactgtatcttccacagccaccagtcatggggcagacgtcagctcagccattccaacaaatatctcacctagtgaactagatgcactgaccccactggtcactatttcggggacagatactagtacaacattcccaacactgactaagtccccacatgaaacagagacaagaaccacatggctcactcatcctgcagagaccagctcaactattcccagaacaatccccaatttttctcatcatgaatcagatgccacaccttcaatagccaccagtcctggggcagaaaccagttcagctattccaattatgactgtctcacctggtgcagaagatctggtgacctcacaggtcactagttctgggacagacagaaatatgactattccaactttgactctttctcctggtgaaccaaagacgatagcctcattagtcacccatcctgaagcacagacaagttcggccattccaacttcaactatctcgcctgctgtatcacggttggtgacctcaatggtcaccagtttggcggcaaagacaagtacaactaatcgagctctgacaaactcccctggtgaaccagctacaacagtttcattggtcacgcatcctgcacagaccagcccaacagttccctggacaacttccatttttttccatagtaaatcagacaccacaccttcaatgaccaccagtcatggggcagaatccagttcagctgttccaactccaa

SEQ ID NO: 4506 - DNA, 11374 bp, synthetic construct
  misc_feature 1..11374: note = Synthetic polypeptide
  source 1..11374: mol_type = other DNA
tgtttcaactgaggtaccaggagtagtgacccctttggtcaccagttctagggcagtgatcagtacaactattccaattctgactctttctcctggtgaaccagagaccacaccttcaatggccaccagtcatggggaagaagccagttctgctattccaactccaactgtttcacctggggtaccaggagtggtgacctctctggtcactagttctagggcagtgactagtacaactattccaattctgactttttctcttggtgaaccagagaccacaccttcaatggccaccagtcatgggacagaagctggctcagctgttccaactgttttacctgaggtaccaggaatggtgacctctctggttgctagttctagggcagtaaccagtacaactcttccaactctgactctttctcctggtgaaccagagaccacaccttcaatggccaccagtcatggggcagaagccagctcaactgttccaactgtttcacctgaggtaccaggagtggtgacctctctggtcactagttctagtggagtaaacagtacaagtattccaactctgattctttctcctggtgaactagaaaccacaccttcaatggccaccagtcatggggcagaagccagctcagctgttccaactccaactgtttcacctggggtatcaggagtggtgacccctctggtcactagttccagggcagtgaccagtacaactattccaattctaactctttcttctagtgagccagagaccacaccttcaatggccaccagtcatggggtagaagccagctcagctgttctaactgtttcacctgaggtaccaggaatggtgacctctctggtcactagttctagagcagtaaccagtacaactattccaactctgactatttcttctgatgaaccagagaccacaacttcattggtcacccattctgaggcaaagatgatttcagccattccaactttagctgtctcccctactgtacaagggctggtgacttcactggtcactagttctgggtcagagaccagtgcgttttcaaatctaactgttgcctcaagtcaaccagagaccatagactcatgggtcgctcatcctgggacagaagcaagttctgttgttccaactttgactgtctccactggtgagccgtttacaaatatctcattggtcacccatcctgcagagagtagctcaactcttcccaggacaacctcaaggttttcccacagtgaattagacactatgccttctacagtcaccagtcctgaggcagaatccagctcagccatttcaacaactatttcacctggtataccaggtgtgctgacatcactggtcactagctctgggagagacatcagtgcaacttttccaacagtgcctgagtccccacatgaatcagaggcaacagcctcatgggttactcatcctgcagtcaccagcacaacagttcccaggacaacccctaattattctcatagtgaaccagacaccacaccatcaatagccaccagtcctggggcagaagccacttcagattttccaacaataactgtctcacctgatgtaccagatatggtaacctcacaggtcactagttctgggacagacaccagtataactattccaactctgactctttcttctggtgagccagagaccacaacctcatttatcacctattctgagacacacacaagttcagccattccaactctccctgtctcccctggtgcatcaaagatgctgacctcactggtcatcagttctgggacagacagcactacaactttcccaacactgacggagaccccatatgaaccagagacaacagccatacagctcattcatcctgcagagaccaacacaatggttcccaggacaactcccaagttttcccatagtaagtcagacaccacactcccagtagccatcaccagtcctgggccagaagccagttcagctgtttcaacgacaactatctcacctgatatgtcagatctggtgacctcactggtccctagttctgggacagacaccagtacaaccttcccaacattgagtgagaccccatatgaaccagagactacagccacgtggctcactcatcctgcagaaaccagcacaacggtttctgggacaattcccaacttttcccataggggatcagacactgcaccctcaatggtcaccagtcctggagtagacacgaggtcaggtgttccaactacaaccatcccacccagtataccaggggtagtgacctcacaggtcactagttctgcaacagacactagtacagctattccaactttgactccttctcctggtgaaccagagaccacagcctcatcagctacccatcctgggacacagactggcttcactgttccaattcggactgttccctctagtgagccagatacaatggcttcctgggtcactcatcctccacagaccagcacacctgtttccagaacaacctccagtttttcccatagtagtccagatgccacacctgtaatggccaccagtcctaggacagaagccagttcagctgtactgacaacaatctcacctggtgcaccagagatggtgacttcacagatcactagttctggggcagcaaccagtacaactgttccaactttgactcattctcctggtatgccagagaccacagccttattgagcacccatcccagaacagagacaagtaaaacatttcctgcttcaactgtgtttcctcaagtatcagagaccacagcctcactcaccattagacctggtgcagagactagcacagctctcccaactcagacaacatcctctctcttcaccctacttgtaactggaaccagcagagttgatctaagtccaactgcttcacctggtgtttctgcaaaaacagccccactttccacccatccagggacagaaaccagcacaatgattccaacttcaactctttcccttggtttactagagactacaggcttactggccaccagctcttcagcagagaccagcacgagtactctaactctgactgtttcccctgctgtctctgggctttccagtgcctctataacaactgataagccccaaactgtgacctcctggaacacagaaacctcaccatctgtaacttcagttggacccccagaattttccaggactgtcacaggcaccactatgaccttgataccatcagagatgccaacaccacctaaaaccagtcatggagaaggagtgagtccaaccactatcttgagaactacaatggttgaagccactaatttagctaccacaggttccagtcccactgtggccaagacaacaaccaccttcaatacactggctggaagcctctttactcctctgaccacacctgggatgtccaccttggcctctgagagtgtgacctcaagaacaagttataaccatcggtcctggatctccaccaccagcagttataaccgtcggtactggacccctgccaccagcactccagtgacttctacattctccccagggatttccacatcctccatccccagctccacagcagccacagtcccattcatggtgccattcaccctcaacttcaccatcaccaacctgcagtacgaggaggacatgcggcaccctggttccaggaagttcaacgccacagagagagaactgcagggtctgctcaaacccttgttcaggaatagcagtctggaatacctctattcaggctgcagactagcctcactcaggccagagaaggatagctcagccacggcagtggatgccatctgcacacatcgccctgaccctgaagacctcggactggacagagagcgactgtactgggagctgagcaatctgacaaatggcatccaggagctgggcccctacaccctggaccggaacagtctctatgtcaatggtttcacccatcgaagctctatgcccaccaccagcactcctgggacctccacagtggatgtgggaacctcagggactccatcctccagccccagccccacgactgctggccctctcctgatgccgttcaccctcaacttcaccatcaccaacctgcagtacgaggaggacatgcgtcgcactggctccaggaagttcaacaccatggagagtgtcctgcagggtctgctcaagcccttgttcaagaacaccagtgttggccctctgtactctggctgcagattgaccttgctcaggcccgagaaagatggggcagccactggagtggatgccatctgcacccaccgccttgaccccaaaagccctggactcaacagggagcagctgtactgggagctaagcaaactgaccaatgacattgaagagctgggcccctacaccctggacaggaacagtctctatgtcaatggtttcacccatcagagctctgtgtccaccaccagcactcctgggacctccacagtggatctcagaacctcagggactccatcctccctctccagccccacaattatggctgctggccctctcctggtaccattcaccctcaacttcaccatcaccaacctgcagtatggggaggacatgggtcaccctggctccaggaagttcaacaccacagagagggtcctgcagggtctgcttggtcccatattcaagaacaccagtgttggccctctgtactctggctgcagactgacctctctcaggtctgagaaggatggagcagccactggagtggatgccatctgcatccatcatcttgaccccaaaagccctggactcaacagagagcggctgtactgggagctgagccaactgaccaatggcatcaaagagctgggcccctacaccctggacaggaacagtctctatgtcaatggtttcacccatcggacctctgtgcccaccagcagcactcctgggacctccacagtggaccttggaacctcagggactccattctccctcccaagccccgcaactgctggccctctcctggtgctgttcaccctcaacttcaccatcaccaacctgaagtatgaggaggacatgcatcgccctggctccaggaagttcaacaccactgagagggtcctgcagactctgcttggtcctatgttcaagaacaccagtgttggccttctgtactctggctgcagactgaccttgctcaggtccgagaaggatggagcagccactggagtggatgccatctgcacccaccgtcttgaccccaaaagccctggagtggacagggagcagctatactgggagctgagccagctgaccaatggcatcaaagagctgggcccctacaccctggacaggaacagtctctatgtcaatggtttcacccattggatccctgtgcccaccagcagcactcctgggacctccacagtggaccttgggtcagggactccatcctccctccccagccccacaactgctggccctctcctggtgccgttcaccctcaacttcaccatcaccaacctgaagtacgaggaggacatgcattgccctggctccaggaagttcaacaccacagagagagtcctgcagagtctgcttggtcccatgttcaagaacaccagtgttggccctctgtactctggctgcagactgaccttgctcaggtccgagaaggatggagcagccactggagtggatgccatctgcacccaccgtcttgaccccaaaagccctggagtggacagggagcagctatactgggagctgagccagctgaccaatggcatcaaagagctgggtccctacaccctggacagaaacagtctctatgtcaatggtttcacccatcagacctctgcgcccaacaccagcactcctgggacctccacagtggaccttgggacctcagggactccatcctccctccccagccctacatctgctggccctctcctggtgccattcaccctcaacttcaccatcaccaacctgcagtacgaggaggacatgcatcacccaggctccaggaagttcaacaccacggagcgggtcctgcagggtctgcttggtcccatgttcaagaacaccagtgtcggccttctgtactctggctgcagactgaccttgctcaggcctgagaagaatggggcagccactggaatggatgccatctgcagccaccgtcttgaccccaaaagccctggactcaacagagagcagctgtactgggagctgagccagctgacccatggcatcaaagagctgggcccctacaccctggacaggaacagtctctatgtcaatggtttcacccatcggagctctgtggcccccaccagcactcctgggacctccacagtggaccttgggacctcagggactccatcctccctccccagccccacaacagctgttcctctcctggtgccgttcaccctcaactttaccatcaccaatctgcagtatggggaggacatgcgtcaccctggctccaggaagttcaacaccacagagagggtcctgcagggtctgcttggtcccttgttcaagaactccagtgtcggccctctgtactctggctgcagactgatctctctcaggtctgagaaggatggggcagccactggagtggatgccatctgcacccaccaccttaaccctcaaagccctggactggacagggagcagctgtactggcagctgagccagatgaccaatggcatcaaagagctgggcccctacaccctggaccggaacagtctctacgtcaatggtttcacccatcggagctctgggctcaccaccagcactccttggacttccacagttgaccttggaacctcagggactccatcccccgtccccagccccacaaccaccggccctctcctggtgccattcacactcaacttcaccatcactaacctacagtatgaggagaacatgggtcaccctggctccaggaagttcaacatcacggagagtgttctgcagggtctgctcaagcccttgttcaagagcaccagtgttggccctctgtattctggctgcagactgaccttgctcaggcctgagaaggatggagtagccaccagagtggacgccatctgcacccaccgccctgaccccaaaatccctgggctagacagacagcagctatactgggagctgagccagctgacccacagcatcactgagctgggaccctacaccctggatagggacagtctctatgtcaatggtttcacccagcggagctctgtgcccaccaccagcactcctgggactttcacagtacagccggaaacctctgagactccatcatccctccctggccccacagccactggccctgtcctgctgccattcaccctcaattttaccatcactaacctgcagtatgaggaggacatgcgtcgccctggctccaggaagttcaacaccacggagagggtccttcagggtctgcttatgcccttgttcaagaacaccagtgtcagctctctgtactctggttgcagactgaccttgctcaggcctgagaaggatggggcagccaccagagtggatgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacccatgaccgccagccctctcctggtgctattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctgacccacagcatcactgagctgggcccctacaccctggacagggacagtctctatgtcaatggtttcacacagcggagctctgtgcccaccactagcattcctgggacccccacagtggacctgggaacatctgggactccagtttctaaacctggtccctcggctgccagccctctcctggtgctattcactctcaacttcaccatcaccaacctgcggtatgaggagaacatgcagcaccctggctccaggaagttcaacaccacggagagggtccttcagggcctgctcaggtccctgttcaagagcaccagtgttggccctctgtactctggctgcagactgactttgctcaggcctgaaaaggatgggacagccactggagtggatgccatctgcacccaccaccctgaccccaaaagccctaggctggacagagagcagctgtattgggagctgagccagctgacccacaatatcactgagctgggcccctatgccctggacaacgacagcctctttgtcaatggtttcactcatcggagctctgtgtccaccaccagcactcctgggacccccacagtgtatctgggagcatctaagactccagcctcgatatttggcccttcagctgccagccatctcctgatactattcaccctcaacttcaccatcactaacctgcggtatgaggagaacatgtggcctggctccaggaagttcaacactacagagagggtccttcagggcctgctaaggcccttgttcaagaacaccagtgttggccctctgtactctggctgcaggctgaccttgctcaggccagagaaagatggggaagccaccggagtggatgccatctgcacccaccgccctgaccccacaggccctgggctggacagagagcagctgtatttggagctgagccagctgacccacagcatcactgagctgggcccctacacactggacagggacagtctctatgtcaatggtttcacccatcggagctctgtacccaccaccagcaccggggtggtcagcgaggagccattcacactgaacttcaccatcaacaacctgcgctacatggcggacatgggccaacccggctccctcaagttcaacatcacagacaacgtcatgcagcacctgctcagtcctttgttccagaggagcagcctgggtgcacggtacacaggctgcagggtcatcgcactaaggtctgtgaagaacggtgctgagacacgggtggacctcctctgcacctacctgcagcccctcagcggcccaggtctgcctatcaagcaggtgttccatgagctgagccagcagacccatggcatcacccggctgggcccctactctctggacaaagacagcctctaccttaacggttacaatgaacctggtccagatgagcctcctacaactcccaagccagccaccacattcctgcctcctctgtcagaagccacaacagccatggggtaccacctgaagaccctcacactcaacttcaccatctccaatctccagtattcaccagatatgggcaagggctcagctacattcaactccaccgagggggtccttcagcacctgctcagacccttgttccagaagagcagcatgggccccttctacttgggttgccaactgatctccctcaggcctgagaaggatggggcagccactggtgtggacaccacctgcacctaccaccctgaccctgtgggccccgggctggacatacagcagctttactgggagctgagtcagctgacccatggtgtcacccaactgggcttctatgtcctggacagggatagcctcttcatcaatggctatgcaccccagaatttatcaatccggggcgagtaccagataaatttccacattgtcaactggaacctcagtaatccagaccccacatcctcagagtacatcaccctgctgagggacatccaggacaaggtcaccacactctacaaaggcagtcaactacatgacacattccgcttctgcctggtcaccaacttgacgatggactccgtgttggtcactgtcaaggcattgttctcctccaatttggaccccagcctggtggagcaagtctttctagataagaccctgaatgcctcattccattggctgggctccacctaccagttggtggacatccatgtgacagaaatggagtcatcagtttatcaaccaacaagcagctccagcacccagcacttctacctgaatttcaccatcaccaacctaccatattcccaggacaaagcccagccaggcaccaccaattaccagaggaacaaaaggaatattgaggatgcgctcaaccaactcttccgaaacagcagcatcaagagttatttttctgactgtcaagtttcaacattcaggtctgtccccaacaggcaccacaccggggtggactccctgtgtaacttctcgccactggctcggagagtagacagagttgccatctatgaggaatttctgcggatgacccggaatggtacccagctgcagaacttcaccctggacaggagcagtgtccttgtggatgggtattctcccaacagaaatgagcccttaactgggaattctgaccttcccttctgggctgtcatcctcatcggcttggcaggactcctgggagtcatcacatgcctgatctgcggtgtcctggctccacaagcagaagaatggcagaacgacacagcagagagaagagaaggagcatctgaatgccgaaaggagttcaactggggacagtcagagaggagactagccactggacagccaaactccaggggaagatcatcttcccactccatcccccttctagctccccatccatcccactgagaaccacctcccccattcaacaaaaccctggcattcatccttcaagtctatgtgtgacctgattcttcctggatgctggacaaggacttgggtaccaagagggcactgagctggttaacacttgagccatccacagacagcaaggctaaggagcacactgtaacacacagccacttgggctttgggagttgcagtctcccacctgtggatgctgccatggggccagagcccagggacactggccccggctcctgcacctgcctgtctgtgtgctccccgtcccataaggggtttgagtgcacccagcagccaaacagatgagccacacccctgtcacatgtcctgcaagggagctcagggaatcctcctgtttca

SEQ ID NO: 4507 - DNA, 4448 bp, synthetic construct
  misc_feature 1..4448: note = Synthetic polypeptide
  source 1..4448: mol_type = other DNA
ccaccggccctctcctggtgccattcacactcaacttcaccatcactaacctacagtatgaggagaacatgggtcaccctggctccaggaagttcaacatcacggagagtgttctgcagggtctgctcaagcccttgttcaagagcaccagtgttggccctctgtattctggctgcagactgaccttgctcaggcctgagaaggatggagtagccaccagagtggacgccatctgcacccaccgccctgaccccaaaatccctgggctagacagacagcagctatactgggagctgagccagctgacccacagcatcactgagctgggaccctacaccctggatagggacagtctctatgtcaatggtttcacccagcggagctctgtgcccaccaccagcactcctgggactttcacagtacagccggaaacctctgagactccatcatccctccctggccccacagccactggccctgtcctgctgccattcaccctcaattttaccatcactaacctgcagtatgaggaggacatgcgtcgccctggctccaggaagttcaacaccacggagagggtccttcagggtctgcttatgcccttgttcaagaacaccagtgtcagctctctgtactctggttgcagactgaccttgctcaggcctgagaaggatggggcagccaccagagtggatgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacccatgaccgccagccctctcctggtgctattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctgacccacagcatcactgagctgggcccctacaccctggacagggacagtctctatgtcaatggtttcacacagcggagctctgtgcccaccactagcattcctgggacccccacagtggacctgggaacatctgggactccagtttctaaacctggtccctcggctgccagccctctcctggtgctattcactctcaacttcaccatcaccaacctgcggtatgaggagaacatgcagcaccctggctccaggaagttcaacaccacggagagggtccttcagggcctgctcaggtccctgttcaagagcaccagtgttggccctctgtactctggctgcagactgactttgctcaggcctgaaaaggatgggacagccactggagtggatgccatctgcacccaccaccctgaccccaaaagccctaggctggacagagagcagctgtattgggagctgagccagctgacccacaatatcactgagctgggcccctatgccctggacaacgacagcctctttgtcaatggtttcactcatcggagctctgtgtccaccaccagcactcctgggacccccacagtgtatctgggagcatctaagactccagcctcgatatttggcccttcagctgccagccatctcctgatactattcaccctcaacttcaccatcactaacctgcggtatgaggagaacatgtggcctggctccaggaagttcaacactacagagagggtccttcagggcctgctaaggcccttgttcaagaacaccagtgttggccctctgtactctggctgcaggctgaccttgctcaggccagagaaagatggggaagccaccggagtggatgccatctgcacccaccgccctgaccccacaggccctgggctggacagagagcagctgtatttggagctgagccagctgacccacagcatcactgagctgggcccctacacactggacagggacagtctctatgtcaatggtttcacccatcggagctctgtacccaccaccagcaccggggtggtcagcgaggagccattcacactgaacttcaccatcaacaacctgcgctacatggcggacatgggccaacccggctccctcaagttcaacatcacagacaacgtcatgcagcacctgctcagtcctttgttccagaggagcagcctgggtgcacggtacacaggctgcagggtcatcgcactaaggtctgtgaagaacggtgctgagacacgggtggacctcctctgcacctacctgcagcccctcagcggcccaggtctgcctatcaagcaggtgttccatgagctgagccagcagacccatggcatcacccggctgggcccctactctctggacaaagacagcctctaccttaacggttacaatgaacctggtccagatgagcctcctacaaccatggggtaccacctgaagaccctcacactcaacttcaccatctccaatctccagtattcaccagatatgggcaagggctcagctacattcaactccaccgagggggtccttcagcacctgctcagacccttgttccagaagagcagcatgggccccttctacttgggttgccaactgatctccctcaggcctgagaaggatggggcagccactggtgtggacaccacctgcacctaccaccctgaccctgtgggccccgggctggacatacagcagctttactgggagctgagtcagctgacccatggtgtcacccaactgggcttctatgtcctggacagggatagcctcttcatcaatggctatgcaccccagaatttatcaatccggggcgagtaccagataaatttccacattgtcaactggaacctcagtaatccagaccccacatcctcagagtacatcaccctgctgagggacatccaggacaaggtcaccacactctacaaaggcagtcaactacatgacacattccgcttctgcctggtcaccaacttgacgatggactccgtgttggtcactgtcaaggcattgttctcctccaatttggaccccagcctggtggagcaagtctttctagataagaccctgaatgcctcattccattggctgggctccacctaccagttggtggacatccatgtgacagaaatggagtcatcagtttatcaaccaacaagcagctccagcacccagcacttctacctgaatttcaccatcaccaacctaccatattcccaggacaaagcccagccaggcaccaccaattaccagaggaacaaaaggaatattgaggatgcgctcaaccaactcttccgaaacagcagcatcaagagttatttttctgactgtcaagtttcaacattcaggtctgtccccaacaggcaccacaccggggtggactccctgtgtaacttctcgccactggctcggagagtagacagagttgccatctatgaggaatttctgcggatgacccggaatggtacccagctgcagaacttcaccctggacaggagcagtgtccttgtggatgggtattctcccaacagaaatgagcccttaactgggaattctgaccttcccttctgggctgtcatcctcatcggcttggcaggactcctgggagtcatcacatgcctgatctgcggtgtcctggctccacaagcagaagaatggcagaacgacacagcagagagaagagaaggagcatctgaatgccgaaaggagttcaactggggacagtcagagaggagactagccactggacagccaaactccaggggaagatcatcttcccactccatcccccttctagctccccatccatcccactgagaaccacctcccccattcaacaaaaccctggcattcatccttcaagtctatgtgtgacctgattcttcctggatgctggacaaggacttgggtaccaagagggcactgagctggttaacacttgagccatccacagacagcaaggctaaggagcacactgtaacacacagccacttgggctttgggagttgcagtctcccacctgtggatgctgccatggggccagagcccagggacactggccccggctcctgcacctgcctgtctgtgtgctccccgtcccataaggggtttgagtgcacccagcagccaaacagatgagccacacccctgtcacatgtcctgcaagggagctcagggaatcctcctgtttca

SEQ ID NO: 4508 - DNA, 3903 bp, synthetic construct
  misc_feature 1..3903: note = Synthetic polypeptide
  source 1..3903: mol_type = other DNA
atgcccttgttcaagaacaccagtgtcagctctctgtactctggttgcagactgaccttgctcaggcctgagaaggatggggcagccaccagagtggatgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacccatgaccgccagccctctcctggtgctattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctgacccacagcatcactgagctgggcccctacaccctggacagggacagtctctatgtcaatggtttcacacagcggagctctgtgcccaccactagcattcctgggacccccacagtggacctgggaacatctgggactccagtttctaaacctggtccctcggctgccagccctctcctggtgctattcactctcaacttcaccatcaccaacctgcggtatgaggagaacatgcagcaccctggctccaggaagttcaacaccacggagagggtccttcagggcctgctcaggtccctgttcaagagcaccagtgttggccctctgtactctggctgcagactgactttgctcaggcctgaaaaggatgggacagccactggagtggatgccatctgcacccaccaccctgaccccaaaagccctaggctggacagagagcagctgtattgggagctgagccagctgacccacaatatcactgagctgggcccctatgccctggacaacgacagcctctttgtcaatggtttcactcatcggagctctgtgtccaccaccagcactcctgggacccccacagtgtatctgggagcatctaagactccagcctcgatatttggcccttcagctgccagccatctcctgatactattcaccctcaacttcaccatcactaacctgcggtatgaggagaacatgtggcctggctccaggaagttcaacactacagagagggtccttcagggcctgctaaggcccttgttcaagaacaccagtgttggccctctgtactctggctgcaggctgaccttgctcaggccagagaaagatggggaagccaccggagtggatgccatctgcacccaccgccctgaccccacaggccctgggctggacagagagcagctgtatttggagctgagccagctgacccacagcatcactgagctgggcccctacacactggacagggacagtctctatgtcaatggtttcacccatcggagctctgtacccaccaccagcaccggggtggtcagcgaggagccattcacactgaacttcaccatcaacaacctgcgctacatggcggacatgggccaacccggctccctcaagttcaacatcacagacaacgtcatgcagcacctgctcagtcctttgttccagaggagcagcctgggtgcacggtacacaggctgcagggtcatcgcactaaggtctgtgaagaacggtgctgagacacgggtggacctcctctgcacctacctgcagcccctcagcggcccaggtctgcctatcaagcaggtgttccatgagctgagccagcagacccatggcatcacccggctgggcccctactctctggacaaagacagcctctaccttaacggttacaatgaacctggtccagatgagcctcctacaactcccaagccagccaccacattcctgcctcctctgtcagaagccacaacagccatggggtaccacctgaagaccctcacactcaacttcaccatctccaatctccagtattcaccagatatgggcaagggctcagctacattcaactccaccgagggggtccttcagcacctgctcagacccttgttccagaagagcagcatgggccccttctacttgggttgccaactgatctccctcaggcctgagaaggatggggcagccactggtgtggacaccacctgcacctaccaccctgaccctgtgggccccgggctggacatacagcagctttactgggagctgagtcagctgacccatggtgtcacccaactgggcttctatgtcctggacagggatagcctcttcatcaatggctatgcaccccagaatttatcaatccggggcgagtaccagataaatttccacattgtcaactggaacctcagtaatccagaccccacatcctcagagtacatcaccctgctgagggacatccaggacaaggtcaccacactctacaaaggcagtcaactacatgacacattccgcttctgcctggtcaccaacttgacgatggactccgtgttggtcactgtcaaggcattgttctcctccaatttggaccccagcctggtggagcaagtctttctagataagaccctgaatgcctcattccattggctgggctccacctaccagttggtggacatccatgtgacagaaatggagtcatcagtttatcaaccaacaagcagctccagcacccagcacttctacctgaatttcaccatcaccaacctaccatattcccaggacaaagcccagccaggcaccaccaattaccagaggaacaaaaggaatattgaggatgcgctcaaccaactcttccgaaacagcagcatcaagagttatttttctgactgtcaagtttcaacattcaggtctgtccccaacaggcaccacaccggggtggactccctgtgtaacttctcgccactggctcggagagtagacagagttgccatctatgaggaatttctgcggatgacccggaatggtacccagctgcagaacttcaccctggacaggagcagtgtccttgtggatgggtattctcccaacagaaatgagcccttaactgggaattctgaccttcccttctgggctgtcatcctcatcggcttggcaggactcctgggagtcatcacatgcctgatctgcggtgtcctggctccacaagcagaagaatggcagaacgacacagcagagagaagagaaggagcatctgaatgccgaaaggagttcaactggggacagtcagagaggagactagccactggacagccaaactccaggggaagatcatcttcccactccatcccccttctagctccccatccatcccactgagaaccacctcccccattcaacaaaaccctggcattcatccttcaagtctatgtgtgacctgattcttcctggatgctggacaaggacttgggtaccaagagggcactgagctggttaacacttgagccatccacagacagcaaggctaaggagcacactgtaacacacagccacttgggctttgggagttgcagtctcccacctgtggatgctgccatggggccagagcccagggacactggccccggctcctgcacctgcctgtctgtgtgctccccgtcccataaggggtttgagtgcacccagcagccaaacagatgagccacacccctgtcacatgtcctgcaagggagctcagggaatcctcctgtttca

SEQ ID NO: 4509 - DNA, 857 bp, synthetic construct; identical to SEQ ID NO: 1374
  misc_feature 1..857: note = Synthetic polypeptide
  source 1..857: mol_type = other DNA

SEQ ID NO: 4510 - DNA, 211 bp, synthetic construct
  misc_feature 1..211: note = Synthetic polypeptide
  source 1..211: mol_type = other DNA
atggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaacacagtggagcaaaaaaacacctagaataaccaacataaggggcaggaagaacagtttcatttt

SEQ ID NO: 4511 - DNA, 1281 bp, synthetic construct
  misc_feature 1..1281: note = Synthetic polypeptide
  source 1..1281: mol_type = other DNA
atggatctgattatttctacactgaatatgtctaagattggttacttctataccgattgtcttgtgccaatggttggaaacaatccatatgcgaccacagaaggaaattcaacagaacttagcataaatgctgaagtgtattcattgccttcaagaaagctggtggctctacagttaagatccatttttattaagtataaatcaaagccattctgtgaaaaactgctttcctgggtgaaaagcagtggctgtgccagagtcattgttctttcaagcagtcattcatatcagcgtaatgatctgcagcttcgtagtactcccttccggtacctacttacaccttccatgcaaaaaagtgttcaaaataaaataaagagccttaactgggaagaaatggaaaaaagccggtgcattcctgaaatagatgattccgagttttgtatccgcattccgggaggaggtatcacaaaaacactctatgatgaaagcttttgcacagcaaaacaaacagcagagtaagcagacaacccacagagtgggagaaatttgcaaactatgcatccgacaaaggaataatatccagaatctataaggaactcaaatgagcaagaaaaaaataatcccattacaaagtggcaaagaacataaatagacaattctcaaaagaagatatacaagcagccaacgaacatgaaaaaatgctcaacatcgctaatcatcagggagatgttaagaccgcaatgagatatcaccttactcctgcaagaacgatcataattaaaaagtcaaaaaaacaatagatgttggtgtgaatgtggtgaaaagggaacacttctacactgctggtgggaatgtaaattagtacaaccactatgggaaacagtgcggagattccttaaagaacaaaaagtagaacaccatctgatccagcaatcccactacagggtatatacccaaaggaaaataagtcattatatgaaaaagacacatgcacacacgtttatagcagcacaattcacaattgcaaagatatagaaccaacctaagtgaccatcaaccaatgagtggataaagaaaatgtggtatattcatcgtggagtactactcttcagccataaaaaggaatgaaataatgtcttttgcagcaacttggatggagccagaggccattattctaagtaaagtaactcagaaatggaaaaccaaatattgtacctctcacaagtgggagctaagctatgagggctcaaaggcataagaatgatataatggactttagca

SEQ ID NO: 4512 - DNA, 1398 bp, synthetic construct
  misc_feature 1..1398: note = Synthetic polypeptide
  source 1..1398: mol_type = other DNA
atgcaacagagccaggttcaagctctgagctgttttactccaaaggctgtggcaataagaactcctctgagaaatgtgtggccagcagtatctgttggaaatgttggccagcttgcaatggatctgattatttctacactgaatatgtctaagattggttacttctataccgattgtcttgtgccaatggttggaaacaatccatatgcgaccacagaaggaaattcaacagaacttagcataaatgctgaagtgtattcattgccttcaagaaagctggtggctctacagttaagatccatttttattaagtataaatcaaagccattctgtgaaaaactgctttcctgggtgaaaagcagtggctgtgccagagtcattgttctttcaagcagtcattcatatcagcgtaatgatctgcagcttcgtagtactcccttccggtacctacttacaccttccatgcaaaaaagtgttcaaaataaaataaagagccttaactgggaagaaatggaaaaaagccggtgcattcctgaaatagatgattccgagttttgtatccgcattccgggaggaggtatcacaaaaacactctatgatgaaagcttttgcacagcaaaacaaacagcagagtaagcagacaacccacagagtgggagaaatttgcaaactatgcatccgacaaaggaataatatccagaatctataaggaactcaaatgagcaagaaaaaaataatcccattacaaagtggcaaagaacataaatagacaattctcaaaagaagatatacaagcagccaacgaacatgaaaaaatgctcaacatcgctaatcatcagggagatgttaagaccgcaatgagatatcaccttactcctgcaagaacgatcataattaaaaagtcaaaaaaacaatagatgttggtgtgaatgtggtgaaaagggaacacttctacactgctggtgggaatgtaaattagtacaaccactatgggaaacagtgcggagattccttaaagaacaaaaagtagaacaccatctgatccagcaatcccactacagggtatatacccaaaggaaaataagtcattatatgaaaaagacacatgcacacacgtttatagcagcacaattcacaattgcaaagatatagaaccaacctaagtgaccatcaaccaatgagtggataaagaaaatgtggtatattcatcgtggagtactactcttcagccataaaaaggaatgaaataatgtcttttgcagcaacttggatggagccagaggccattattctaagtaaagtaactcagaaatggaaaaccaaatattgtacctctcacaagtgggagctaagctatgagggctcaaaggcataagaatgatataatggactttagca

SEQ ID NO: 4513 - DNA, 1374 bp, synthetic construct
  misc_feature 1..1374: note = Synthetic polypeptide
  source 1..1374: mol_type = other DNA
atgttcgttccctgcggggagtcggcccccgaccttgccggcttcaccctcctaatgccagcagtatctgttggaaatgttggccagcttgcaatggatctgattatttctacactgaatatgtctaagattggttacttctataccgattgtcttgtgccaatggttggaaacaatccatatgcgaccacagaaggaaattcaacagaacttagcataaatgctgaagtgtattcattgccttcaagaaagctggtggctctacagttaagatccatttttattaagtataaatcaaagccattctgtgaaaaactgctttcctgggtgaaaagcagtggctgtgccagagtcattgttctttcaagcagtcattcatatcagcgtaatgatctgcagcttcgtagtactcccttccggtacctacttacaccttccatgcaaaaaagtgttcaaaataaaataaagagccttaactgggaagaaatggaaaaaagccggtgcattcctgaaatagatgattccgagttttgtatccgcattccgggaggaggtatcacaaaaacactctatgatgaaagcttttgcacagcaaaacaaacagcagagtaagcagacaacccacagagtgggagaaatttgcaaactatgcatccgacaaaggaataatatccagaatctataaggaactcaaatgagcaagaaaaaaataatcccattacaaagtggcaaagaacataaatagacaattctcaaaagaagatatacaagcagccaacgaacatgaaaaaatgctcaacatcgctaatcatcagggagatgttaagaccgcaatgagatatcaccttactcctgcaagaacgatcataattaaaaagtcaaaaaaacaatagatgttggtgtgaatgtggtgaaaagggaacacttctacactgctggtgggaatgtaaattagtacaaccactatgggaaacagtgcggagattccttaaagaacaaaaagtagaacaccatctgatccagcaatcccactacagggtatatacccaaaggaaaataagtcattatatgaaaaagacacatgcacacacgtttatagcagcacaattcacaattgcaaagatatagaaccaacctaagtgaccatcaaccaatgagtggataaagaaaatgtggtatattcatcgtggagtactactcttcagccataaaaaggaatgaaataatgtcttttgcagcaacttggatggagccagaggccattattctaagtaaagtaactcagaaatggaaaaccaaatattgtacctctcacaagtgggagctaagctatgagggctcaaaggcataagaatgatataatggactttagca

SEQ ID NO: 4514 - DNA, 1885 bp, synthetic construct
  misc_feature 1..1885: note = Synthetic polypeptide
  source 1..1885: mol_type = other DNA
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgaggggg

SEQ ID NO: 4515 - DNA, 2107 bp, synthetic construct
  misc_feature 1..2107: note = Synthetic polypeptide
  source 1..2107: mol_type = other DNA
atgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgtaagccgtggtttcgccttcgtggagttttatcacttgcaagatgctaccagctggatggaagccaatcagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgctttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctatcgacgatccaggctgagcgagcaggagctggaagccttggagctaagggagagagagagagagagagaga

SEQ ID NO: 4516 - DNA, 357 bp, synthetic construct
  misc_feature 1..357: note = Synthetic polypeptide
  source 1..357: mol_type = other DNA
atgagttggcgaggaagatcgacctatcggcctagaccaagacgctacgtagagcctcctgaaatgattgggcctatgcggcccgagcagttcagtgatgaagtggaaccagcaacacctgaagaaggggaaccagcaactcaacgtcaggatcctgcagctgctcaggagggacaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggctgtaaagctttattgggagaattttaa

SEQ ID NO: 4517 - DNA, 2103 bp, synthetic construct
  misc_feature 1..2103: note = Synthetic polypeptide
  source 1..2103: mol_type = other DNA
atgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgtaagccgtggtttcgccttcgtggagttttatcacttgcaagatgctaccagctggatggaagccaatcagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgctttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctatcgacgatccaggctgagcgagcaggagctggaagccttggagctaagggagagagagagagagaga

SEQ ID NO: 4518 - DNA, 2154 bp, synthetic construct; identical to SEQ ID NO: 1502
  misc_feature 1..2154: note = Synthetic polypeptide
  source 1..2154: mol_type = other DNA

SEQ ID NO: 4519 - DNA, 2025 bp, synthetic construct; identical to SEQ ID NO: 1503
  misc_feature 1..2025: note = Synthetic polypeptide
  source 1..2025: mol_type = other DNA

SEQ ID NO: 4520 - DNA, 490 bp, synthetic construct
  misc_feature 1..490: note = Synthetic polypeptide
  source 1..490: mol_type = other DNA
atggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaagggacatctctgaaggtctctgccaactccagagctcccgccctgaggaatttgctgggcttttgttgcgactgcactggagttcgccttctcactctccccaaccctgcatctgtcatggcttcaatgatagttctaagagcactcccaataagcctctgagagatctctgcctcaaatctgtgcttcccttgttatccaacc

SEQ ID NO: 4521 - DNA, 301 bp, synthetic construct
  misc_feature 1..301: note = Synthetic polypeptide
  source 1..301: mol_type = other DNA
gggggagggagtggtccttagctgaatgcgcctgcgttgtggcggcctccggcgccccaaggatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgaggctgaggcaggatcatcacttgaagctcggagtttgagaccagcctgggcaaaatagcaagaccccacccatttctacaaagaaacaagaa

SEQ ID NO: 4522 - DNA, 299 bp, synthetic construct
  misc_feature 1..299: note = Synthetic polypeptide
  source 1..299: mol_type = other DNA
gttgtggcggcctccggcgccccaaggtactttctccccagcaaggaatccgcgtgcgcgatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgaggctgaggcaggatcatcacttgaagctcggagtttgagaccagcctgggcaaaatagcaagaccccacccatttctacaaagaaacaagaa

SEQ ID NO: 4523 - DNA, 410 bp, synthetic construct
  misc_feature 1..410: note = Synthetic polypeptide
  source 1..410: mol_type = other DNA
atggcggcgcagggcgtagggcctgggccggggtcggcggcgcccccggggctggaggcggcccggcagaagctggcgctgcggcggaagaaggtgctgagcaccgaggagatggagctgtacgagctggcgcaggcggcgggcggcgctatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgaggctgaggcaggatcatcacttgaagctcggagtttgagaccagcctgggcaaaatagcaagaccccacccatttctacaaagaaacaagaa

SEQ ID NO: 4524 - DNA, 48 bp, synthetic construct
  misc_feature 1..48: note = Synthetic polypeptide
  source 1..48: mol_type = other DNA
atgctccacgccctcctgcgatctagaatgccttatttaaaatagcac

SEQ ID NO: 4525 - DNA, 743 bp, synthetic construct
  misc_feature 1..743: note = Synthetic polypeptide
  source 1..743: mol_type = other DNA
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagggccatccccaaacccatccccaagccaaactcaacaccatccccttccctaatcacctctcctgcccctagctcagcctcatccccaactccatgcctgtctccaatcccaaccctgcccccaatctcccctcaactccaa

SEQ ID NO: 4526 - DNA, 680 bp, synthetic construct
  misc_feature 1..680: note = Synthetic polypeptide
  source 1..680: mol_type = other DNA
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttgtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagggccatccccaaacccatccccaagccaaactcaacaccatccccttccctaatcacctctcctgcccctagctcagcctcatccccaactccatgcctgtctccaatcccaaccctgcccccaatctcccctcaactccaa

SEQ ID NO: 4527 - DNA, 377 bp, synthetic construct
  misc_feature 1..377: note = Synthetic polypeptide
  source 1..377: mol_type = other DNA
atgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggggtcatattact

SEQ ID NO: 4528 - DNA, 377 bp, synthetic construct
  misc_feature 1..377: note = Synthetic polypeptide
  source 1..377: mol_type = other DNA
atgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggtaaatgctggacgccactgtggggctctgagagtcctgaattcttactgggttggggtcatattact

SEQ ID NO: 4529 - DNA, 611 bp, synthetic construct
  misc_feature 1..611: note = Synthetic polypeptide
  source 1..611: mol_type = other DNA
aatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacaggcccggg

SEQ ID NO: 4530 - DNA, 288 bp, synthetic construct
  misc_feature 1..288: note = Synthetic polypeptide
  source 1..288: mol_type = other DNA
atgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacaggcccggg

SEQ ID NO: 4531 - DNA, 475 bp, synthetic construct
  misc_feature 1..475: note = Synthetic polypeptide
  source 1..475: mol_type = other DNA
atggacgcgctcaagtcggcggggcgggcgctgatccggagccccagcttggccaagcagagctgggggggcggtggccggcaccgcaagctgcctgagaactggacagacacgcgggagacgctgctggaggggatgctgttcagcctcaagtacctgggcatgacgctagtggagcagcccaagggtgaggagctgtcggccgccgccatcaagaggatcgtggctacagctaaggccagtgggaagaagctgcagaaggtgactctgaaggtgtcgccacggggaattatcctgacagacaacctcaccaaccagctcattgagaacgtgtccatatacaggatctcctattgcacagcagacaagatgcacgacaaggtgtttgcatacatcgcccagagccagcacaaccagagcctcgagtgccacgccttcctctgcaccaagcggaagatgagatcctgactaatac

SEQ ID NO: 4532 - DNA, 729 bp, synthetic construct
  misc_feature 1..729: note = Synthetic polypeptide
  source 1..729: mol_type = other DNA
atgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggcctgctacgaggtgtttggatcatggggacgggtatttcatggcttggtgctgttttcttgatggtgaattattgcaagatacggtcatttaaaattgtgtggcacctccccctgcccccttcttgctcctgctttcaccatgtgacatgcctgatcccccttcaccttttgccatggtcataagcttcctgaggcctccctggaagctgagcagatgccagcaccatgcttcctgtacatcctgcagaaccataagccaattaaacctttttaataataaattactcagtctcaagtatttttttatagcaatacaagaa

SEQ ID NO: 4533 - DNA, 620 bp, synthetic construct
  misc_feature 1..620: note = Synthetic polypeptide
  source 1..620: mol_type = other DNA
cgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggcctgctacgaggtgtttggatcatggggacgggtatttcatggcttggtgctgttttcttgatggtgaattattgcaagatacggtcatttaaaattgtgtggcacctccccctgcccccttcttgctcctgctttcaccatgtgacatgcctgatcccccttcaccttttgccatggtcataagcttcctgaggcctccctggaagctgagcagatgccagcaccatgcttcctgtacatcctgcagaaccataagccaattaaacctttttaataataaattactcagtctcaagtatttttttatagcaatacaagaa

SEQ ID NO: 4534 - DNA, 567 bp, synthetic construct
  misc_feature 1..567: note = Synthetic polypeptide
  source 1..567: mol_type = other DNA
atgggactagctggcgtgtgcgccctgagacgctcagcgggctatatactcgtcggtggggccggcggtcagtctgcggcagcggcagcaagacggtacagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagagattacttcctccacccctccctatctca

SEQ ID NO: 4535 - DNA, 435 bp, synthetic construct
  misc_feature 1..435: note = Synthetic polypeptide
  source 1..435: mol_type = other DNA
atgggactagctggcgtgtgcgccctgagacgctcagcgggctatatactcgtcggtggggccggcggtcagtctgcggcagcggcagcaagacggtacagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaaggttcggctcctggctgatcccactggggcctttgggaaggagacagacttattactagatgattcgctggtgtccatctttgggaatcgacgtctcaagagattacttcctccacccctccctatctca

SEQ ID NO: 4536 - DNA, 300 bp, synthetic construct
  misc_feature 1..300: note = Synthetic polypeptide
  source 1..300: mol_type = other DNA
atgggactagctggcgtgtgcgccctgagacgctcagcgggctatatactcgtcggtggggccggcggtcagtctgcggcagcggcagcaagacggtacagtgaaggagagtgggcgtctggcggggtccgcagtttcagcagagccgctgcagccatggccccaatcaaggttcggctcctggctgatcccactggggcctttgggaaggagacagacttattactagatgattcgctggtgtccatctttgggaatcgacgtctcaagagattacttcctccacccctccctatctca

SEQ ID NO: 4537 - DNA, 1692 bp, synthetic construct; identical to SEQ ID NO: 1048
  misc_feature 1..1692: note = Synthetic polypeptide
  source 1..1692: mol_type = other DNA

SEQ ID NO: 4538 - DNA, 1695 bp, synthetic construct; identical to SEQ ID NO: 1049
  misc_feature 1..1695: note = Synthetic polypeptide
  source 1..1695: mol_type = other DNA

SEQ ID NO: 4539 - DNA, 466 bp, synthetic construct; identical to SEQ ID NO: 1050
  misc_feature 1..466: note = Synthetic polypeptide
  source 1..466: mol_type = other DNA

SEQ ID NO: 4540 - DNA, 550 bp, synthetic construct
  misc_feature 1..550: note = Synthetic polypeptide
  source 1..550: mol_type = other DNA
atggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaagaaaaaaaaagtgaaaaaaagaaacgaaaaggacagacgaagagtttaaagagaaaagggaaaaaagaaagaaaaagtaa

SEQ ID NO: 4541 - DNA, 2849 bp, synthetic construct; identical to SEQ ID NO: 1326
  misc_feature 1..2849: note = Synthetic polypeptide
  source 1..2849: mol_type = other DNA

SEQ ID NO: 4542 - DNA, 1925 bp, synthetic construct; identical to SEQ ID NO: 1327
  misc_feature 1..1925: note = Synthetic polypeptide
  source 1..1925: mol_type = other DNA

SEQ ID NO: 4543 - DNA, 2729 bp, synthetic construct; identical to SEQ ID NO: 1328
  misc_feature 1..2729: note = Synthetic polypeptide
  source 1..2729: mol_type = other DNA

SEQ ID NO: 4544 - DNA, 2549 bp, synthetic construct; identical to SEQ ID NO: 1329
  misc_feature 1..2549: note = Synthetic polypeptide
  source 1..2549: mol_type = other DNA

SEQ ID NO: 4545 - DNA, 583 bp, synthetic construct
  misc_feature 1..583: note = Synthetic polypeptide
  source 1..583: mol_type = other DNA
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggggg

SEQ ID NO: 4546 - DNA, 520 bp, synthetic construct
  misc_feature 1..520: note = Synthetic polypeptide
  source 1..520: mol_type = other DNA
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttgtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggggg

SEQ ID NO: 4547 - DNA, 1370 bp, synthetic construct
  misc_feature 1..1370: note = Synthetic polypeptide
  source 1..1370: mol_type = other DNA
atggcggccctgggacatcttgctggggaggcagcggcggccccaggcccgggtactccctgcgcgtcccgcggagcccggcttcccggcccagtttccagcgcccggaatccttccactgtctgtctctgcccagagcaacctacgtgcagtaacgctgactccagagcgcacccgttgggcgatgaaggcggcacagcgtcgaaaaaacaaaagaataagaagaaaacgcggaacagggcctctgtggcaaatggaggcgagaaggcctcagagaaactcgccccagaagaagttcccctaagcgctgaggcccaggcacaacagttggcccaggaattggcttggtgtgtggagcaactggagctgggcctcaagaggcagaaacccaccccgaaacagaaagagcaggctattggagcaatccgaaccctgcgcagcaaaagaacgcccttgccccggaagaggcagctgatgcactccttgtttggagactatagggctcagatggaagccgaatggcgtgaggccctgcgggctctcagagctgctgcttattcagcccaggtgcaacctgtagatggagccaccagaaagaagagccaaagggtctgcaggcctcgctctatatggagagccaaagccactctggacatgcctgatgaagagtttagggccaccagagggcttggtctagcagtaacaccagtgtctgggaagatgcctgttgcaaagtggaccatggtctagcagtagcatcagtgtcaaggaaaaacacccactacttagcagactgggaaaaggagcctccctttccccgggggagtttagagaagactactcctccacctcttgtggagggcctgacatcagtcaggcccgcccgcagttatccagaggcctgtctccctgtgatgctgtgcttcagtggtcacgctcctagtccgctttcatgttccatcctgtatacctggctctgccttttagatagcaggagcaaattagtgaaagtactaaatgtctgatatgcagaaataatggcataagctgtctctctctcttctctctctctctgcctctgctgccaggcagggaagggccccctgtccagtggacacatgacccatgtgaccttacctattattggagatggttcacattccttaccctgcccctttgtcttatatccaataaatatcagtgcagcctggcatttggggccactactggtctccgcgtcttggtggtagtggtcccccaggcccaggtgtcttttcttttatctctttgtcttgtgtctttatttctacaatctctcatctctgcacatggggagaaaacccactgaccctgtggggctggaccctaca

SEQ ID NO: 4548 - DNA, 106 bp, synthetic construct
  misc_feature 1..106: note = Synthetic polypeptide
  source 1..106: mol_type = other DNA
atgaccgataaaacagagaaggtgccgccgtctctcctccagcaaggtcaggacttcaggactgtgagtgggcagtttttccctggatgctttaatttcgccctgg

SEQ ID NO: 4549 - DNA, 958 bp, synthetic construct
  misc_feature 1..958: note = Synthetic polypeptide
  source 1..958: mol_type = other DNA
atggtagatggaaccctccttttactcctctcggaggccctggcccttacccagacctgggcgggctcccactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctactacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcctccactagagtgatgctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattct

SEQ ID NO: 4550 - DNA, 776 bp, synthetic construct
  misc_feature 1..776: note = Synthetic polypeptide
  source 1..776: mol_type = other DNA
atggccgcgccggccccgggcctcatctcggtgttctcgagttcccaggagctgggtgcggcgctagcgcagctggtggcccagcgcgcagcatgctgcctggcaggggcccgcgcccgtttcgcgctcggcctgtcgggcgggagcctcgtctcgatgctagcccgcgagctacccgccgccgtcgcccctgccgggccagctagcttagcgcgctggacgctgggcttctgcgacgagcgcctcgtgcccttcgatcacgccgagagcacgtacggcctctaccggacgcatcttctctccagactgccgatcccagaaagccaggtgatcaccattaaccccgagctgcctgtggaggaggcggctgaggactacgccaagaagctgagacaggcattccaaggggactccatcccggttttcgacctgctgatcctgggggtgggccccgatggtcacacctgctcactcttcccagaccaccccctcctacaggagcgggagaagattgtggctcccatcagtgactccccgaagccaccgccacagcgtgtgaccctcacactacctgtcctgaatgcagcacgaactgtcatctttgtggcaactggagaaggcaaggcagctgttctgaagctactcaggaggctgaggcagaagaatcgcttgaaaccgggaggcggaggttgccgtgagccaagatcgtaccactgcactccagcctgggagacagagtgagactccatctcaaaataaataaataaataaataaa

SEQ ID NO: 4551 - DNA, 2647 bp, synthetic construct; identical to SEQ ID NO: 2625
  misc_feature 1..2647: note = Synthetic polypeptide
  source 1..2647: mol_type = other DNA

SEQ ID NO: 4552 - DNA, 296 bp, synthetic construct
  misc_feature 1..296: note = Synthetic polypeptide
  source 1..296: mol_type = other DNA
atggcggccaccatgaagaaggcggctgcagaagatgtcaatgttactttcgaagatcaacaaaagataaacaaatttgcacggaatacaagtagaatcacagagctgaaggaagaaatagaagtaaaaaagaaacaactccaaaacctagaagatgcttgtgatgacatcatgcttgcagatgatgattgcttaatgataccttatcaaattggtgatgtcttcattagccattctcaagaagaaacgcaagaaatgttagaagaagcaaagaattaatttaaaatatttttttt

SEQ ID NO: 4553 - DNA, 360 bp, synthetic construct
  misc_feature 1..360: note = Synthetic polypeptide
  source 1..360: mol_type = other DNA
atgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaaggctgtaaagctttattgggagaattttaa

SEQ ID NO: 4554 - DNA, 1277 bp, synthetic construct; identical to SEQ ID NO: 2164
  misc_feature 1..1277: note = Synthetic polypeptide
  source 1..1277: mol_type = other DNA

SEQ ID NO: 4555 - DNA, 1223 bp, synthetic construct; identical to SEQ ID NO: 2165
  misc_feature 1..1223: note = Synthetic polypeptide
  source 1..1223: mol_type = other DNA

SEQ ID NO: 4556 - DNA, 1325 bp, synthetic construct; identical to SEQ ID NO: 2166
  misc_feature 1..1325: note = Synthetic polypeptide
  source 1..1325: mol_type = other DNA

SEQ ID NO: 4557 - DNA, 914 bp, synthetic construct; identical to SEQ ID NO: 2167
  misc_feature 1..914: note = Synthetic polypeptide
  source 1..914: mol_type = other DNA

SEQ ID NO: 4558 - DNA, 195 bp, synthetic construct
  misc_feature 1..195: note = Synthetic polypeptide
  source 1..195: mol_type = other DNA
atggccaagccgtgtggggtgcgcctgagcggggaagcccgcaaacaggtggaggtcttcagacagaatcttttccaggagtcctttcattttcaggtcttcagtttcctcatttgcaagtcttggacccagtgatttccaaaggcccttccagttccatttgtcagacatctcattgagcatattctgtgattc

SEQ ID NO: 4559 - DNA, 266 bp, synthetic construct; identical to SEQ ID NO: 2578
  misc_feature 1..266: note = Synthetic polypeptide
  source 1..266: mol_type = other DNA

SEQ ID NO: 4560 - DNA, 106 bp, synthetic construct; identical to SEQ ID NO: 4548
  misc_feature 1..106: note = Synthetic polypeptide
  source 1..106: mol_type = other DNA

SEQ ID NO: 4561 - DNA, 791 bp, synthetic construct
  misc_feature 1..791: note = Synthetic polypeptide
  source 1..791: mol_type = other DNA
atgtggttcatgtacctgctgagctggctgtcgctcttcatccaggtggccttcatcacgctggctgtcgcggctggactctattacctggcagaactgatagaagaatacacagtggccaccagcaggatcataaaatacatgatctggttctccaccgctgtactgattggcctctacgtctttgagcgcttccccaccagcatgattggagtgggcctattcaccaacctcgtctactttggcctcctccagaccttccccttcatcatgctgacctcgcctaacttcatcctgtcgtgtggactagtggtggtgaatcattacctagcatttcagttttttgcagaagaatattatcccttctcagaggtccatggcccagatggtacttgctgtcttctgcaaacctgccccttctgggtacttcccttgaccccgagatcactcaggagccagacaggaaacttattctattcctgttttctctttctgcccaccacatccaatctctcaaaacggtcaggtctaccttaacatctcttgatttgagccactcccactgtcatcagctttcacctggattatcgtgacagcctcctactgcttctctatcatgtggccagagctatcttcctaaaatgcattgcatagttgatcaagtcactctctggcctaaaaccttccttggctccctgctgccctcaggataaagtctggacccctcagcatggcttgtgagactcatggtgtccttgtccctgctcacctctctggtctcatcacttgcc

SEQ ID NO: 4562 - DNA, 721 bp, synthetic construct
  misc_feature 1..721: note = Synthetic polypeptide
  source 1..721: mol_type = other DNA
cagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggatcatttatgcttgggaggtcgaggctgcagtgagtcatgattgtatgactgcactccagcctgggtgacagagcaagaccctgtttcaaaaagaaaaa

SEQ ID NO: 4563 - DNA, 1789 bp, synthetic construct
  misc_feature 1..1789: note = Synthetic polypeptide
  source 1..1789: mol_type = other DNA
atggaagaaaacccgaccttggaatcagaagcctggggctcctctagggggtggctggccccccgggaggccagaggaggcccatcgctgtcttctgtgctgaacgagctgcccagtgctgccacccttcggtaccgagaccctggggtgctgccttggggggcgctggaggaggaggaggaggatggaggaaggagcagaaaggccttcacagaagtcacccagacagagctgcaggaccctcacccttcccgggaactgccctggcccatgcaggccagacgggcacacaggcaaagaaatgccagcagggaccaggtggtctatggctctggaactaagacggaccgatgggcgcggctacttcggaggtccaaggagaaaacaaaggaaggcttgcgaagcctgcagccctgggcgtggacactgaagaggatcgggggccagtttggcgccggcacggagtcctacttctccctgctgcgcttcctgctccttcttaacgtgctggcctctgtgctcatggcctgcatgacgctgctgcccacctggttgggaggcgctcccccaggccctcccggccccgacatctcctcgccctgcggctcctataacccccactcccagggcctggtcacctttgccacccagctcttcaacttgctctcgggtgagggttacctggaatggtcccctctcttctatggcttctacccgccccgcccacgcctggcggtcacctacctgtgctgggcctttgccgttggcctcatctgcctcctgctcatcctgcatcgctcggtgtctgggctgaagcagacactgctggcggagtccgaggctctgaccagctacagccaccgggtgttctcggcctgggacttcggtctctgcggggacgtccacgtgcggctgcgccagcgcatcatcttgtacgaattaaaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaggagttccaggtgcccgacgaggtgctggggctcatctacgcgcagacggtggtctgggtggggagttttttctgccctttactgcccctgcttaacacggtcaagttcctgctgcttttctacctgaagaagggaggtgaaggtcgaagtgagccaagatcgtgccactgcactccagcctgggcgacagagcgagactccgtctcaaaaagagaaaacaaacaaacaacaacaa

SEQ ID NO: 4564 - DNA, 553 bp, synthetic construct
  misc_feature 1..553: note = Synthetic polypeptide
  source 1..553: mol_type = other DNA
atgaagggtgggggcggtcagagggatgttggcgctgacaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaggagttccaggtgcccgacgaggtgctggggctcatctacgcgcagacggtggtctgggtggggagttttttctgccctttactgcccctgcttaacacggtcaagttcctgctgcttttctacctgaagaagggaggtgaaggtcgaagtgagccaagatcgtgccactgcactccagcctgggcgacagagcgagactccgtctcaaaaagagaaaacaaacaaacaacaacaa

SEQ ID NO: 4565 - DNA, 1807 bp, synthetic construct
  misc_feature 1..1807: note = Synthetic polypeptide
  source 1..1807: mol_type = other DNA
atggaagaaaacccgaccttggaatcagaagcctggggctcctctagggggtggctggccccccgggaggccagaggagccccctgctcctccccaggcccatcgctgtcttctgtgctgaacgagctgcccagtgctgccacccttcggtaccgagaccctggggtgctgccttggggggcgctggaggaggaggaggaggatggaggaaggagcagaaaggccttcacagaagtcacccagacagagctgcaggaccctcacccttcccgggaactgccctggcccatgcaggccagacgggcacacaggcaaagaaatgccagcagggaccaggtggtctatggctctggaactaagacggaccgatgggcgcggctacttcggaggtccaaggagaaaacaaaggaaggcttgcgaagcctgcagccctgggcgtggacactgaagaggatcgggggccagtttggcgccggcacggagtcctacttctccctgctgcgcttcctgctccttcttaacgtgctggcctctgtgctcatggcctgcatgacgctgctgcccacctggttgggaggcgctcccccaggccctcccggccccgacatctcctcgccctgcggctcctataacccccactcccagggcctggtcacctttgccacccagctcttcaacttgctctcgggtgagggttacctggaatggtcccctctcttctatggcttctacccgccccgcccacgcctggcggtcacctacctgtgctgggcctttgccgttggcctcatctgcctcctgctcatcctgcatcgctcggtgtctgggctgaagcagacactgctggcggagtccgaggctctgaccagctacagccaccgggtgttctcggcctgggacttcggtctctgcggggacgtccacgtgcggctgcgccagcgcatcatcttgtacgaattaaaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaggagttccaggtgcccgacgaggtgctggggctcatctacgcgcagacggtggtctgggtggggagttttttctgccctttactgcccctgcttaacacggtcaagttcctgctgcttttctacctgaagaagggaggtgaaggtcgaagtgagccaagatcgtgccactgcactccagcctgggcgacagagcgagactccgtctcaaaaagagaaaacaaacaaacaacaacaa

SEQ ID NO: 4566 - DNA, 6132 bp, synthetic construct; identical to SEQ ID NO: 1117
  misc_feature 1..6132: note = Synthetic polypeptide
  source 1..6132: mol_type = other DNA

SEQ ID NO: 4567 - DNA, 894 bp, synthetic construct
  misc_feature 1..894: note = Synthetic polypeptide
  source 1..894: mol_type = other DNA
atggccgcggacgaagttgccggaggggcgcgcaaagccacgaaaagcaaactttttgagtttctggtccatggggtgcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggttctagtcctgagtctggactctgggtaagtgactcagcgattctgaaccttgtttccttatctttgaagtggagtgacaatacctgtcctatctactctcctgggcagttaggaaaatcaaattgctgcaaaagtgattgagcaaaattccaccaaaacagagaatattcttatt

SEQ ID NO: 4568 - DNA, 855 bp, synthetic construct
  misc_feature 1..855: note = Synthetic polypeptide
  source 1..855: mol_type = other DNA
atgactccaggtcttcagcacccacccaccgtggtacagcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggttctagtcctgagtctggactctgggtaagtgactcagcgattctgaaccttgtttccttatctttgaagtggagtgacaatacctgtcctatctactctcctgggcagttaggaaaatcaaattgctgcaaaagtgattgagcaaaattccaccaaaacagagaatattcttatt

SEQ ID NO: 4569 - DNA, 186 bp, synthetic construct; identical to SEQ ID NO: 2172
  misc_feature 1..186: note = Synthetic polypeptide
  source 1..186: mol_type = other DNA

SEQ ID NO: 4570 - DNA, 437 bp, synthetic construct
  misc_feature 1..437: note = Synthetic polypeptide
  source 1..437: mol_type = other DNA
atgtcttctcacaagactttcaggattaagcgattcctggccaagaaacaaaagcaaaatcgtcccattccccagtggattcggatgaaaactggaaataaaatcaggtccacgctgcttttatgagctgtaacacttaaccgccaaaatctgcagcttcacgcctgagcccagtgagactacgagcccactgggaggaatgaacaactccccacgcgctgccgtaagagctgtaacactcaccgggaaggtctgcagcttcactcttgagcaagtgagaccacgaacccaccagaagaaaaaaactccaaacacatctgaacatcagaagggacagactccagacgcgccaccttaagagctgtaacactcaccgcgagggtccgcggcttccttcttgaagtcagtgagaccaaaaacccaccaattccagacac

SEQ ID NO: 4571 - DNA, 382 bp, synthetic construct
  misc_feature 1..382: note = Synthetic polypeptide
  source 1..382: mol_type = other DNA
atggggagcagccgctgtgggcctggggctcaccctgttcacctgtggcccccacactttgcattctctggtcaccatcctcgggacctgggccctcattcaggcccagccctgctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacagggcaacctccatcctagcatctgctgctgtgagggtgggcatgtgtctgggtctacgtctcacacctccgctggaccagagctgctttggggtagaagctggctgtct

SEQ ID NO: 4572 - DNA, 601 bp, synthetic construct
  misc_feature 1..601: note = Synthetic polypeptide
  source 1..601: mol_type = other DNA
atgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacagggcaacctccatcctagcatctgctgctgtgagggtgggcatgtgtctgggtctacgtctcacacctccgctggaccagagctgctttggggtagaagctggctgtct

SEQ ID NO: 4573 - DNA, 457 bp, synthetic construct
  misc_feature 1..457: note = Synthetic polypeptide
  source 1..457: mol_type = other DNA
cacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacagggcaacctccatcctagcatctgctgctgtgagggtgggcatgtgtctgggtctacgtctcacacctccgctggaccagagctgctttggggtagaagctggctgtct

SEQ ID NO: 4574 - DNA, 222 bp, synthetic construct
  misc_feature 1..222: note = Synthetic polypeptide
  source 1..222: mol_type = other DNA
ggaaggaaatggcctcaggcttcagcaaggggcccaccctggggctgctgcccgacgtgccctccctgatggagacactcagctacagctactgctacgtgggaatcatgacagggcaacctccatcctagcatctgctgctgtgagggtgggcatgtgtctgggtctacgtctcacacctccgctggaccagagctgctttggggtagaagctggctgtct

SEQ ID NO: 4575 - DNA, 299 bp, synthetic construct
  misc_feature 1..299: note = Synthetic polypeptide
  source 1..299: mol_type = other DNA
ttcttgctgcattcatcatcacctctgactggatacccctgggggtcaatagtcaacgaggagacgatgtgactcaagcgactccagaaacattcacagaagatcctaatctggtgaatgatcccgctacagatgaaacagtttgcttgcacttgctgtccttccaccatgggatgactctcatcagatgatggcaccatgttcttggacttctcagcctccagaactgtgagaaataaatttcttttctttataaattactcagttggtgacagactcaataacacaaaatagactaa

SEQ ID NO: 4576 - DNA, 330 bp, synthetic construct
  misc_feature 1..330: note = Synthetic polypeptide
  source 1..330: mol_type = other DNA
atgtcgctcttgggacccaaggtgctgctgtttcttgctgcattcatcatcacctctgactggatacccctgggggtcaatagtcaacgaggagacgatgtgactcaagcgactccagaaacattcacagaagatcctaatctggtgaatgatcccgctacagatgaaacagtttgcttgcacttgctgtccttccaccatgggatgactctcatcagatgatggcaccatgttcttggacttctcagcctccagaactgtgagaaataaatttcttttctttataaattactcagttggtgacagactcaataacacaaaatagactaa

SEQ ID NO: 4577 - DNA, 294 bp, synthetic construct
  misc_feature 1..294: note = Synthetic polypeptide
  source 1..294: mol_type = other DNA
atgtcgctcttgggacccaaggtgctgctgtttcttgctgcattcatcatcacctctgacgatgtgactcaagcgactccagaaacattcacagaagatcctaatctggtgaatgatcccgctacagatgaaacagtttgcttgcacttgctgtccttccaccatgggatgactctcatcagatgatggcaccatgttcttggacttctcagcctccagaactgtgagaaataaatttcttttctttataaattactcagttggtgacagactcaataacacaaaatagactaa

SEQ ID NO: 4578 - DNA, 91 bp, synthetic construct; identical to SEQ ID NO: 223
  misc_feature 1..91: note = Synthetic polypeptide
  source 1..91: mol_type = other DNA

SEQ ID NO: 4579 - DNA, 104 bp, synthetic construct
  misc_feature 1..104: note = Synthetic polypeptide
  source 1..104: mol_type = other DNA
atgagggcgcggccgcaggtctgcgaggcgctgctcttcgccctggcgctccagaccggcgtgtgctatggcatcaagtggctgcttgcgaaaagggagtgaga

SEQ ID NO: 4580 - DNA, 1193 bp, synthetic construct
  misc_feature 1..1193: note = Synthetic polypeptide
  source 1..1193: mol_type = other DNA
atggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggccct

SEQ ID NO: 4581 - DNA, 1181 bp, synthetic construct
  misc_feature 1..1181: note = Synthetic polypeptide
  source 1..1181: mol_type = other DNA
atggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggccct

SEQ ID NO: 4582 - DNA, 106 bp, synthetic construct; identical to SEQ ID NO: 4548
  misc_feature 1..106: note = Synthetic polypeptide
  source 1..106: mol_type = other DNA

SEQ ID NO: 4583 - DNA, 397 bp, synthetic construct; identical to SEQ ID NO: 3335
  misc_feature 1..397: note = Synthetic polypeptide
  source 1..397: mol_type = other DNA

SEQ ID NO: 4584 - DNA, 289 bp, synthetic construct; identical to SEQ ID NO: 3336
  misc_feature 1..289: note = Synthetic polypeptide
  source 1..289: mol_type = other DNA

SEQ ID NO: 4585 - DNA, 1106 bp, synthetic construct
  misc_feature 1..1106: note = Synthetic polypeptide
  source 1..1106: mol_type = other DNA
atgaatgagtgtcactatgacaagcacatggactttttttataataggagcaacactgatactgtcgatgactggacaggaacaaagcttgtgattgttttgtgtgttgggacgtttttctgcctgtttatttttttttctaattctctggtcatcgcggcagtgatcaaaaacagaaaatttcatttccccttctactacctgttggctaatttagctgctgccgatttcttcgctggaattgcctatgtattcctgatgtttaacacaggcccagtttcaaaaactttgactgtcaaccgctggtttctccgtcaggggcttctggacagtagcttgactgcttccctcaccaacttgctggttatcgccgtggagaggcacatgtcaatcatgaggatgcgggtccatagcaacctgaccaaaaagagggtgacactgctcattttgcttgtctgggccatcgccatttttatgggggcggtccccacactgggctggaattgcctctgcaacatctctgcctgctcttccctggcccccatttacagcaggagttaccttgttttctggacagtgtccaacctcatggccttcctcatcatggttgtggtgtacctgcggatctacgtgtacgtcaagaggaaaaccaacgtcttgtctccgcatacaagtgggtccatcagccgccggaggacacccatgaagctaatgaagacggtgatgactgtcttaggggcgtttgtggtatgctggaccccgggcctggtggttctgctcctcgacggcctgaactgcaggcagtgtggcgtgcagcatgtgaaaaggtggttcctgctgctggcgctgctcaactccgtcgtgaaccccatcatctactcctacaaggacgaggacatgtatggcaccatgaagaagatgatctgctgcttctctcaggagaacccagagaggcgtccctctcgcatcccctccacagtcctcagcaggagtgacacaggcagccagtacatagaggatagtattagccaagatcgcagcactgcactctagtctgggtgacagagcaagactctgtctcaaaaaaaaaaaaaaaaaaaaaaaaa

SEQ ID NO: 4586 - DNA, 657 bp, synthetic construct
  misc_feature 1..657: note = Synthetic polypeptide
  source 1..657: mol_type = other DNA
atgcacgtgcgctcactgcgagctgcggcgccgcacagcttcgtggcgctctgggcacccctgttcctgctgcgctccgccctggccgacttcagcctggacaacgaggtgcactcgagcttcatccaccggcgcctccgcagccaggagcggcgggagatgcagcgcgagatcctctccattttgggcttgccccaccgcccgcgcccgcacctccagggcaagcacaactcggcacccatgttcatgctggacctgtacaacgccatggcggtggaggagggcggcgggcccggcggccagggcttctcctacccctacaaggccgtcttcagtacccagggcccccctctggccagcctgcaagatagccatttcctcaccgacgccgacatggtcatgagcttcgtcaacctcgtggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagggctggcggggagattcagagaaccgaggcgtggaaagcaccgaga

SEQ ID NO: 4587 - DNA, 313 bp, synthetic construct
  misc_feature 1..313: note = Synthetic polypeptide
  source 1..313: mol_type = other DNA
cccccctctggccagcctgcaagatagccatttcctcaccgacgccgacatggtcatgagcttcgtcaacctcgtggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagggctggcggggagattcagagaaccgaggcgtggaaagcaccgaga

SEQ ID NO: 4588 - DNA, 390 bp, synthetic construct
  misc_feature 1..390: note = Synthetic polypeptide
  source 1..390: mol_type = other DNA
atgtcggactacagcacgggaggacccccgcccgggccgccgccgcccgccggcgggggcgggggagccggaggcgccgggggaggccctccgccgggcccgccaggcgcgggggaccggggcggcggcggtcccggcggcggcggcccgggcggggggtcggccgggggcccctctcagccacccggcggaggcggcccgggaatccgcaaggacgctttcgccgacgccgtgcagcgggcccgccagattgcagccaaaattggaggcgatgctgccacgacagtgaataacagcactcctgattttggttttgggggccaaaagagacagttggaagatggagatcgttgccaccttccaacctacctcacaggggtgttgtgggga

SEQ ID NO: 4589 - DNA, 218 bp, synthetic construct
  misc_feature 1..218: note = Synthetic polypeptide
  source 1..218: mol_type = other DNA
cctctcagccacccggcggaggcggcccgggaatccgcaaggacgctttcgccgacgccgtgcagcgggcccgccagattgcagccaaaattggaggcgatgctgccacgacagtgaataacagcactcctgattttggttttgggggccaaaagagacagttggaagatggagatcgttgccaccttccaacctacctcacaggggtgttgtgggga

SEQ ID NO: 4590 - DNA, 81 bp, synthetic construct
  misc_feature 1..81: note = Synthetic polypeptide
  source 1..81: mol_type = other DNA
atgactcggaaagcgctcagaagaacgcttcgcccgttggtgctatacgtcctggggtagaaacagcttccagcaacaccc

SEQ ID NO: 4591 - DNA, 1248 bp, synthetic construct
  misc_feature 1..1248: note = Synthetic polypeptide
  source 1..1248: mol_type = other DNA
atggcggccccggagccggcgccgaggcgggcccgggaacgggagcgggagcgggaggacgagagcgaggacgagagcgacatcctggaggaaagcccgtgtggtcgctggcaaaagcgacgggagcaggtaaaccaagggaacatgccagggcttcagagcaccttcctagccatggacacggaggagggggtagaggtggtgtggaacgagctccacttcggagacaggaaggccttcgcggcgcacgaggagaagatccagaccgtgttcgagcagctggtgctggtggaccacccgaacatcgtgaagttgcacaagtactggctggatacctctgaggcctgcgcgagggtcatcttcatcacagagtacgtgtcatcaggcagcctcaagcaattcctcaaaaagaccaagaagaaccacaaggccatgaacgcccgggcctggaagcgctggtgcacgcagatcctgtctgcgctcagcttcctgcacgcctgcagccccccaatcatccacgggaacctgaccagcgacaccatcttcattcagcacaacggcctcatcaagatcggctccgtgtggcaccgaatcttctccaatgcacttccagatgatctccgaagccccatccgcgctgagcgagaggaacttcggaacctgcacttcttccccccagagtatggagaggtggccgatgggaccgctgtggacatcttctcctttgggatgtgtgcgctggagatggctgtactggaaatccagaccaatggggacacccgggtcacagaggaggccattgctcgcgccaggcactcgctgagtgaccccaacatgcgggagttcatcctttgctgcctggcccgggaccctgcccgccggccctctgcccacagcctcctcttccaccgcgtgctcttcgaggtgcactcgctgaagctcctggcagcccactgcttcatccagcaccagtacctcatgcctgagaatgtggtggaggagaagaccaaggccatggacctgcacgcggtcttggcggagcttccccggccccgcaggcccccgctgcagtggcggtactcggaagtctccttcatggagctggacaaattcctggaggatgtcagctcctggctccctgcctctctcccactccactcctggctcagtcttagagatttctatgccctcatggattctacccctgccttcctggcctcttgattcttggcttgcctctcctccaat

SEQ ID NO: 4592 - DNA, 519 bp, synthetic construct
  misc_feature 1..519: note = Synthetic polypeptide
  source 1..519: mol_type = other DNA
atgtgtgcgctggagatggctgtactggaaatccagaccaatggggacacccgggtcacagaggaggccattgctcgcgccaggcactcgctgagtgaccccaacatgcgggagttcatcctttgctgcctggcccgggaccctgcccgccggccctctgcccacagcctcctcttccaccgcgtgctcttcgaggtgcactcgctgaagctcctggcagcccactgcttcatccagcaccagtacctcatgcctgagaatgtggtggaggagaagaccaaggccatggacctgcacgcggtcttggcggagcttccccggccccgcaggcccccgctgcagtggcggtactcggaagtctccttcatggagctggacaaattcctggaggatgtcagctcctggctccctgcctctctcccactccactcctggctcagtcttagagatttctatgccctcatggattctacccctgccttcctggcctcttgattcttggcttgcctctcctccaat

SEQ ID NO: 4593 - DNA, 809 bp, synthetic construct
  misc_feature 1..809: note = Synthetic polypeptide
  source 1..809: mol_type = other DNA
atgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagaggtttgaactgcactggtccactgatagacaaagtttcttctgactgtgccaccccaagacagcaagaccaacccgttttcctcctcctcctcagcctactcgacgcgaagatgacaaggatgaagatctttatgatgatccacttccacttaatgaatagtaaacatagttttttctttcttatgagtttcctgatagcattccttttctctagcttactttattgtaagagtataatacatatagcagacaaaatatgcgttaatcaactgtttatgttatcactaaggcttcaggtaaacagaaggctattagtagttaagctctgggggagtcaaaagttatacatggatttttagctgcagggaggctggcacccctaacctccacgttgttcaagattcaatt

SEQ ID NO: 4594 - DNA, 836 bp, synthetic construct
  misc_feature 1..836: note = Synthetic polypeptide
  source 1..836: mol_type = other DNA
atgcggggctctggtctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagaggtttgaactgcactggtccactgatagacaaagtttcttctgactgtgccaccccaagacagcaagaccaacccgttttcctcctcctcctcagcctactcgacgcgaagatgacaaggatgaagatctttatgatgatccacttccacttaatgaatagtaaacatagttttttctttcttatgagtttcctgatagcattccttttctctagcttactttattgtaagagtataatacatatagcagacaaaatatgcgttaatcaactgtttatgttatcactaaggcttcaggtaaacagaaggctattagtagttaagctctgggggagtcaaaagttatacatggatttttagctgcagggaggctggcacccctaacctccacgttgttcaagattcaatt

SEQ ID NO: 4595 - DNA, 512 bp, synthetic construct
  misc_feature 1..512: note = Synthetic polypeptide
  source 1..512: mol_type = other DNA
atgcttcgaactctggcccaagccaagaaggaatgctgggatcggttcctccaggagaagttagcttcagagttctttgtggatggacttgattctgatgagaggtttgaactgcactggtccactgatagacaaagtttcttctgactgtgccaccccaagacagcaagaccaacccgttttcctcctcctcctcagcctactcgacgcgaagatgacaaggatgaagatctttatgatgatccacttccacttaatgaatagtaaacatagttttttctttcttatgagtttcctgatagcattccttttctctagcttactttattgtaagagtataatacatatagcagacaaaatatgcgttaatcaactgtttatgttatcactaaggcttcaggtaaacagaaggctattagtagttaagctctgggggagtcaaaagttatacatggatttttagctgcagggaggctggcacccctaacctccacgttgttcaagattcaatt

SEQ ID NO: 4596 - DNA, 106 bp, synthetic construct; identical to SEQ ID NO: 4548
  misc_feature 1..106: note = Synthetic polypeptide
  source 1..106: mol_type = other DNA

SEQ ID NO: 4597 - DNA, 154 bp, synthetic construct; identical to SEQ ID NO: 2227
  misc_feature 1..154: note = Synthetic polypeptide
  source 1..154: mol_type = other DNA

SEQ ID NO: 4598 - DNA, 3992 bp, synthetic construct; identical to SEQ ID NO: 120
  misc_feature 1..3992: note = Synthetic polypeptide
  source 1..3992: mol_type = other DNA

SEQ ID NO: 4599 - DNA, 3845 bp, synthetic construct; identical to SEQ ID NO: 121
  misc_feature 1..3845: note = Synthetic polypeptide
  source 1..3845: mol_type = other DNA

SEQ ID NO: 4600 - DNA, 314 bp, synthetic construct; identical to SEQ ID NO: 998
  misc_feature 1..314: note = Synthetic polypeptide
  source 1..314: mol_type = other DNA

SEQ ID NO: 4601 - DNA, 1221 bp, synthetic construct; identical to SEQ ID NO: 122
  misc_feature 1..1221: note = Synthetic polypeptide
  source 1..1221: mol_type = other DNA

SEQ ID NO: 4602 - DNA, 999 bp, synthetic construct; identical to SEQ ID NO: 983
  misc_feature 1..999: note = Synthetic polypeptide
  source 1..999: mol_type = other DNA

SEQ ID NO: 4603 - DNA, 868 bp, synthetic construct
  misc_feature 1..868: note = Synthetic polypeptide
  source 1..868: mol_type = other DNA
atgatgctccggctgctcagttccctcctccttgtggccgttgcctcaggctatggcccaccttcctctcgcccttccagccgcgttgtcaatggtgaggatgcggtcccctacagctggccctggcaggtttccctgcagtatgagaaaagcggaagcttctaccacacctgtggcggtagcctcatcgcccccgactgggttgtgactgccggccactgcatctcgagctcccggacctaccaggtggtgttgggcgagtacgaccgtgctgtgaaggagggccccgagcaggtgatccccatcaactctggggacctctttgtgcatccactctggaaccgctcgtgtgtggcctgtggcaatgacatcgccctcatcaagctctcacgcagcgcccagctgggagacgccgtccagctcgcctcactccctccggctggtgacatccttcccaacgagacaccctgctacatcaccggctggggccgtctctataccaacgggccactcccagacaagctgcaggaggccctgctgccggtggtggactatgaacactgctccaggtggaactggtggggttcctccgtgaagaagaccatggtgtgtgctggaggggacatccgctccggctgcaatggtgactctggaggacccctcaactgccccacagaggatggtggctggcaggtccatggcgtgaccagctttgtttctgcctttggctgcaacacccgcaggaagcccacggtgttcactcgagtctccgccttcattgactggattgaggaggggctgtgcagaatggaaaccacacttgcctgtctcccaggaagccaggtgaggctgtgtgctgatttctggc

SEQ ID NO: 4604 - DNA, 577 bp, synthetic construct
  misc_feature 1..577: note = Synthetic polypeptide
  source 1..577: mol_type = other DNA
caggtgatccccatcaactctggggacctctttgtgcatccactctggaaccgctcgtgtgtggcctgtggcaatgacatcgccctcatcaagctctcacgcagcgcccagctgggagacgccgtccagctcgcctcactccctccggctggtgacatccttcccaacgagacaccctgctacatcaccggctggggccgtctctataccaacgggccactcccagacaagctgcaggaggccctgctgccggtggtggactatgaacactgctccaggtggaactggtggggttcctccgtgaagaagaccatggtgtgtgctggaggggacatccgctccggctgcaatggtgactctggaggacccctcaactgccccacagaggatggtggctggcaggtccatggcgtgaccagctttgtttctgcctttggctgcaacacccgcaggaagcccacggtgttcactcgagtctccgccttcattgactggattgaggaggggctgtgcagaatggaaaccacacttgcctgtctcccaggaagccaggtgaggctgtgtgctgatttctggc

SEQ ID NO: 4605 - DNA, 569 bp, synthetic construct; identical to SEQ ID NO: 426
  misc_feature 1..569: note = Synthetic polypeptide
  source 1..569: mol_type = other DNA

SEQ ID NO: 4606 - DNA, 154 bp, synthetic construct; identical to SEQ ID NO: 2227
  misc_feature 1..154: note = Synthetic polypeptide
  source 1..154: mol_type = other DNA

SEQ ID NO: 4607 - DNA, 942 bp, synthetic construct
  misc_feature 1..942: note = Synthetic polypeptide
  source 1..942: mol_type = other DNA
atgattaggaccctgctgctgtccactttggtggctggagccctcagttgtggggtctccacttacgcgcctgatatgtctaggatgcttggaggtgaagaagcgaggcccaacagctggccctggcaggtctccctgcagtacagctccaatggccagtggtaccacacctgcggagggtccctgatagccaacagctgggtcctgacggctgcccactgcatcagctcctccgggatctaccgcgtgatgctgggccagcataacctctacgttgcagagtccggctcgctggccgtcagtgtctctaagattgtggtgcacaaggactggaactccgaccaggtctccaaagggaacgacattgccctgctcaaactggctaaccccgtctccctcaccgacaagatccagctggcctgcctccctcctgccggcaccattctacccaacaactacccctgctacgtcacgggctggggaaggctgcagaccaacggggctctccctgatgacctgaagcagggccagttgctggttgtggactatgccacctgctccagctctggctggtggggcagcaccgtgaagacgaatatgatctgtgctgggggtgatggcgtgatatgcacctgcaacggagactccggtgggccgctgaactgtcaggcatctgacggccggtgggaggtgcatggcatcggcagcctcacgtcggtccttggttgcaactactactacaagccctccatcttcacgcgggtctccaactacaacgactggatcaattcgccatggtggtgcatgcctgtagtctcagctgcttgggaggctgaggtggaaggatcgctttggcccaagaggtggagcctacagtaagccaaggtcgcaccactgcactgcagcctgagcgacatagcaagaccctgtctctgaaaataa

SEQ ID NO: 4608 - DNA, 734 bp, synthetic construct; identical to SEQ ID NO: 930
  misc_feature 1..734: note = Synthetic polypeptide
  source 1..734: mol_type = other DNA

SEQ ID NO: 4609 - DNA, 510 bp, synthetic construct; identical to SEQ ID NO: 1633
  misc_feature 1..510: note = Synthetic polypeptide
  source 1..510: mol_type = other DNA

SEQ ID NO: 4610 - DNA, 607 bp, synthetic construct; identical to SEQ ID NO: 2299
  misc_feature 1..607: note = Synthetic polypeptide
  source 1..607: mol_type = other DNA

SEQ ID NO: 4611 - DNA, 577 bp, synthetic construct; identical to SEQ ID NO: 2300
  misc_feature 1..577: note = Synthetic polypeptide
  source 1..577: mol_type = other DNA

SEQ ID NO: 4612 - DNA, 604 bp, synthetic construct; identical to SEQ ID NO: 2301
  misc_feature 1..604: note = Synthetic polypeptide
  source 1..604: mol_type = other DNA

SEQ ID NO: 4613 - DNA, 834 bp, synthetic construct
  misc_feature 1..834: note = Synthetic polypeptide
  source 1..834: mol_type = other DNA
atgctgccactttggactctttcactgctgctgggagcagtagcaggaaaagaagtttgctacgaaagactcggctgcttcagtgatgactccccatggtcaggaattacggaaagacccctccatatattgccttggtctccaaaagatgtcaacacccgcttcctcctatatactaatgagaacccaaacaactttcaagaagttgccgcagattcatcaagcatcagtggctccaatttcaaaacaaatagaaaaactcgctttattattcatggattcatagacaagggagaagaaaactggctggccaatgtgtgcaagaatctgttcaaggtggaaagtgtgaactgtatctgtgtggactggaaaggtggctcccgaactggatacacacaagcctcgcagaacatcaggatcgtgggagcagaagtggcatattttgttgaatttcttcagtatactccttcaacttattaaagaaaaataaaacagcctcaggcagatccttcaggaagtattccagaagaagacatgttatcataggagatgacagcttcatgcatgttattgcccctgaaaaccttccagggaacaagatgtggaagtggaagacagtgatattgatgatcctgaccctgtgtaggcctaggctaatgcaggtgtttgtgtcttagtttttaacaaaaaattttgacaagttaaaaaaattatcataaaaatggttatagaatcaagatataaagaagtaaaataatttgatacagggatacagagtgttttaagctaaaggttattacaaaaagttaaaagtttaaaaaaaataaaaattgt

SEQ ID NO: 4614 - DNA, 201 bp, synthetic construct
  misc_feature 1..201: note = Synthetic polypeptide
  source 1..201: mol_type = other DNA
atgattaggaccctgctgctgtccactttggtggctggagccctcagttgtggggtctccacttacgcgcctgatatgtctaggatgcttggaggtgaagaagcgaggcccaacagctggccctggcaggttttgggtgcccccttaagttgtgtacctgaggtgagtgcctcactcccccttacccttgtcccagccccg

SEQ ID NO: 4615 - DNA, 153 bp, synthetic construct
  misc_feature 1..153: note = Synthetic polypeptide
  source 1..153: mol_type = other DNA
tgtggggtctccacttacgcgcctgatatgtctaggatgcttggaggtgaagaagcgaggcccaacagctggccctggcaggttttgggtgcccccttaagttgtgtacctgaggtgagtgcctcactcccccttacccttgtcccagccccg

SEQ ID NO: 4616 - DNA, 3934 bp, synthetic construct; identical to SEQ ID NO: 1150
  misc_feature 1..3934: note = Synthetic polypeptide
  source 1..3934: mol_type = other DNA

SEQ ID NO: 4617 - DNA, 3787 bp, synthetic construct; identical to SEQ ID NO: 1151
  misc_feature 1..3787: note = Synthetic polypeptide
  source 1..3787: mol_type = other DNA

SEQ ID NO: 4618 - DNA, 867 bp, synthetic construct; identical to SEQ ID NO: 1152
  misc_feature 1..867: note = Synthetic polypeptide
  source 1..867: mol_type = other DNA

SEQ ID NO: 4619 - DNA, 996 bp, synthetic construct; identical to SEQ ID NO: 1153
  misc_feature 1..996: note = Synthetic polypeptide
  source 1..996: mol_type = other DNA

SEQ ID NO: 4620 - DNA, 1158 bp, synthetic construct; identical to SEQ ID NO: 1301
  misc_feature 1..1158: note = Synthetic polypeptide
  source 1..1158: mol_type = other DNA

SEQ ID NO: 4621 - DNA, 2927 bp, synthetic construct; identical to SEQ ID NO: 3132
  misc_feature 1..2927: note = Synthetic polypeptide
  source 1..2927: mol_type = other DNA

SEQ ID NO: 4622 - DNA, 2930 bp, synthetic construct; identical to SEQ ID NO: 3133
  misc_feature 1..2930: note = Synthetic polypeptide
  source 1..2930: mol_type = other DNA

SEQ ID NO: 4623 - DNA, 201 bp, synthetic construct
  misc_feature 1..201: note = Synthetic polypeptide
  source 1..201: mol_type = other DNA
atgataaggacgctgctgctgtccactttggtggctggagccctcagttgtggggaccccacttacccaccttatgtgactagggtggttggcggtgaagaagcgaggcccaacagctggccctggcaggttttgggtgcccccttaagttgtgtacctgaggtgagtgcctcactcccccttacccttgtcccagccccg

SEQ ID NO: 4624 - DNA, 1288 bp, synthetic construct; identical to SEQ ID NO: 1042
  misc_feature 1..1288: note = Synthetic polypeptide
  source 1..1288: mol_type = other DNA

SEQ ID NO: 4625 - DNA, 931 bp, synthetic construct; identical to SEQ ID NO: 1043
  misc_feature 1..931: note = Synthetic polypeptide
  source 1..931: mol_type = other DNA

SEQ ID NO: 4626 - DNA, 850 bp, synthetic construct; identical to SEQ ID NO: 1044
  misc_feature 1..850: note = Synthetic polypeptide
  source 1..850: mol_type = other DNA

SEQ ID NO: 4627 - DNA, 1954 bp, synthetic construct; identical to SEQ ID NO: 1045
  misc_feature 1..1954: note = Synthetic polypeptide
  source 1..1954: mol_type = other DNA

SEQ ID NO: 4628 - DNA, 1873 bp, synthetic construct; identical to SEQ ID NO: 1046
  misc_feature 1..1873: note = Synthetic polypeptide
  source 1..1873: mol_type = other DNA

SEQ ID NO: 4629 - DNA, 1888 bp, synthetic construct; identical to SEQ ID NO: 1047
  misc_feature 1..1888: note = Synthetic polypeptide
  source 1..1888: mol_type = other DNA

SEQ ID NO: 4630 - DNA, 476 bp, synthetic construct
  misc_feature 1..476: note = Synthetic polypeptide
  source 1..476: mol_type = other DNA
atgtgcggacctgacgacagatgccccgcacgctggccgggaccgggaagggcggtcaagtgtggaaagggtctggcggctgccaggcctggcagagtggagcggggcggggcgcagcggggcggggcgggcctggagctgcacccgcttctgggtggacgcacttggcgagcggcgcgggatgcagacggctgcgaggcgctgggcacagttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacggcaattaactcaaacttctcaggaagacagtgtgaataccagtgagtatttaacactctacctctggtaactgtagagtgtatagacagagctgagaaccgctg

SEQ ID NO: 4631 - DNA, 341 bp, synthetic construct
  misc_feature 1..341: note = Synthetic polypeptide
  source 1..341: mol_type = other DNA
atgagagagacaagtggcttcacattgaagaaggggaggagtgcgccattggttttccatcctccagatgcactgattgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacggcaattaactcaaacttctcaggaagacagtgtgaataccagtgagtatttaacactctacctctggtaactgtagagtgtatagacagagctgagaaccgctg

SEQ ID NO: 4632 - DNA, 347 bp, synthetic construct
  misc_feature 1..347: note = Synthetic polypeptide
  source 1..347: mol_type = other DNA
atgcacatgagagagacaagtggcttcacattgaagaaggggaggagtgcgccattggttttccatcctccagatgcactgattgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacggcaattaactcaaacttctcaggaagacagtgtgaataccagtgagtatttaacactctacctctggtaactgtagagtgtatagacagagctgagaaccgctg

SEQ ID NO: 4633 - DNA, 284 bp, synthetic construct
  misc_feature 1..284: note = Synthetic polypeptide
  source 1..284: mol_type = other DNA
atgggacctgcgggggaggttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacggcaattaactcaaacttctcaggaagacagtgtgaataccagtgagtatttaacactctacctctggtaactgtagagtgtatagacagagctgagaaccgctg

SEQ ID NO: 4634 - DNA, 305 bp, synthetic construct
  misc_feature 1..305: note = Synthetic polypeptide
  source 1..305: mol_type = other DNA
atgaatccattcctgatccttgcctttgtgggagctgctgttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacggcaattaactcaaacttctcaggaagacagtgtgaataccagtgagtatttaacactctacctctggtaactgtagagtgtatagacagagctgagaaccgctg

SEQ ID NO: 4635 - DNA, 630 bp, synthetic construct
  misc_feature 1..630: note = Synthetic polypeptide
  source 1..630: mol_type = other DNA
atggctttcctctggctcctctcctgctgggccctcctgggtaccaccttcggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgacacggagaagcggagaagaccaccatctgcaagccaaggaaagaggcctcagaagaaacaaccctgctaataccttgatctcggccgccatgcctctagaactgtgagaaaatacatttctgttgtttaagctacccagttggtagtacagcagccctagcaaagtaaca

SEQ ID NO: 4636 - DNA, 369 bp, synthetic construct
  misc_feature 1..369: note = Synthetic polypeptide
  source 1..369: mol_type = other DNA
gagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgacacggagaagcggagaagaccaccatctgcaagccaaggaaagaggcctcagaagaaacaaccctgctaataccttgatctcggccgccatgcctctagaactgtgagaaaatacatttctgttgtttaagctacccagttggtagtacagcagccctagcaaagtaaca

SEQ ID NO: 4637 - DNA, 474 bp, synthetic construct
  misc_feature 1..474: note = Synthetic polypeptide
  source 1..474: mol_type = other DNA
gacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgacacggagaagcggagaagaccaccatctgcaagccaaggaaagaggcctcagaagaaacaaccctgctaataccttgatctcggccgccatgcctctagaactgtgagaaaatacatttctgttgtttaagctacccagttggtagtacagcagccctagcaaagtaaca

SEQ ID NO: 4638 - DNA, 378 bp, synthetic construct
  misc_feature 1..378: note = Synthetic polypeptide
  source 1..378: mol_type = other DNA
gtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgacacggagaagcggagaagaccaccatctgcaagccaaggaaagaggcctcagaagaaacaaccctgctaataccttgatctcggccgccatgcctctagaactgtgagaaaatacatttctgttgtttaagctacccagttggtagtacagcagccctagcaaagtaaca

SEQ ID NO: 4639 - DNA, 2961 bp, synthetic construct; identical to SEQ ID NO: 3268
  misc_feature 1..2961: note = Synthetic polypeptide
  source 1..2961: mol_type = other DNA

SEQ ID NO: 4640 - DNA, 2964 bp, synthetic construct; identical to SEQ ID NO: 3269
  misc_feature 1..2964: note = Synthetic polypeptide
  source 1..2964: mol_type = other DNA

SEQ ID NO: 4641 - DNA, 235 bp, synthetic construct; identical to SEQ ID NO: 1657
  misc_feature 1..235: note = Synthetic polypeptide
  source 1..235: mol_type = other DNA

SEQ ID NO: 4642 - DNA, 1078 bp, synthetic construct; identical to SEQ ID NO: 1658
  misc_feature 1..1078: note = Synthetic polypeptide
  source 1..1078: mol_type = other DNA

SEQ ID NO: 4643 - DNA, 213 bp, synthetic construct
  misc_feature 1..213: note = Synthetic polypeptide
  source 1..213: mol_type = other DNA
atgttgggcatcactgtcctcgctgcgctcttggcctgtgccaggcgtggtggcgggcacctgtaatcccaactactcagaaggctgaggcaggagaattgcttgaacccaggaggaggttgcagtgagccgagatcgcgccatcaaactccagcctgggcaacaagagtgaaactccgtctcaaaaaaaaaaaaaaaagaaaaagaaagaaa

SEQ ID NO: 4644 - DNA, 485 bp, synthetic construct
  misc_feature 1..485: note = Synthetic polypeptide
  source 1..485: mol_type = other DNA
atgctgcccccttggaccctcggccttctcctgctggccacagtcagagggagaaaagtctgctacggacaacttggctgcttttctgatgaaaaaccatgggcaggaacccttcagcgacctgtaaaattacttccctggtcccccgaggacattgacacccgctttcttctgtacacaaatgaaaatccaaacaacttccaactaatcactggcacggaaccagacaccattgaggcttcaaacttccaactggaccgcaagacacgcttcatcatccatggcttcttagacaaggcggaggacagctggccatcggacatgtgcaagaaaatgtttgaagtggagaaggtgaactgcatctgtgtggactggaggcacgggtcccgggcaatgtacacccaagccgtgcaaaacattcgggttgttggggcggagacagctttcttaatacaagcactgtcggctgttctgcaagggtcaga

SEQ ID NO: 4645 - DNA, 484 bp, synthetic construct
  misc_feature 1..484: note = Synthetic polypeptide
  source 1..484: mol_type = other DNA
atgctgcccccttggaccctcggccttctcctgctggccacagtcagaggaaaagagtctgctacggacaacttggctgcttttctgatgaaaaaccatgggcaggaacccttcagcgacctgtaaaattacttccctggtcccccgaggacattgacacccgctttcttctgtacacaaatgaaaatccaaacaacttccaactaatcactggcacggaaccagacaccattgaggcttcaaacttccaactggaccgcaagacacgcttcatcatccatggcttcttagacaaggcggaggacagctggccatcggacatgtgcaagaaaatgtttgaagtggagaaggtgaactgcatctgtgtggactggaggcacgggtcccgggcaatgtacacccaagccgtgcaaaacattcgggttgttggggcggagacagctttcttaatacaagcactgtcggctgttctgcaagggtcaga

SEQ ID NO: 4646 - DNA, 489 bp, synthetic construct
  misc_feature 1..489: note = Synthetic polypeptide
  source 1..489: mol_type = other DNA
atgatgtggtccaacttcttcctgcaagaggagaaccggcggcggggggccgcgggccggcggcgggcgcacgggcagggcaggtcggggctgacgcccgagcgcgaggggaaggtgaagctggcgctgctgctggccgccgtgggcgccacgctggcggtgctgtccgtgggcaccgagttctgggtggagctcaacacctacaaggccaacggcagcgccgtgtgcgaagcggcccacctggggctgtggaaggcgtgcaccaagcggctgtggcaggcggacgtgcccgtggacagggacacctgcggccccgcggagctgcccggagaagcaaactgcacctattttaaattcttcaccacgggggagaatgcacgcatctttcagagaaccacaaagaaagtgactttagagaaataactgaccctttctgagtcttaattccttcaacagtgtaagtaaaatgttgggctggatgatactcta

SEQ ID NO: 4647 - DNA, 728 bp, synthetic construct
  misc_feature 1..728: note = Synthetic polypeptide
  source 1..728: mol_type = other DNA
atgggtggtatcctgcacagcccgacctccccggagcctcccgacaccacctccccggagtctcccgacaccacctccccggagtctcccgacaccacctcccaggagcctcccgacaccacctccccggagcctcccgacaagacctccccggagcccgccccccagcagggctccacacacacccccaggagcccaggctccaccaggactcgccgccctgagatctcccaggctgggcccacgcagggagaagtgatcccaacaggctcgtccaaacctgcgggtgaccagctgcccgcggctctgtggaccagcagtgcggtgctgggactgctgctcctggccttgcccacctatcacctctggaaacgctgccggcacctggctgaggacgacacccacccaccagcttctctgaggcttctgccccagagatggatgcatgttctgattgcctctttggagaagctcatcagaaactcaaaagaaggccactgtttgtctcacctacccatgacctgaagcccctccctgagtggtccccacctttctggacggaaccacgtactttttacatacattgattcatgtctcacgtctccctaaaaatgcgtaagaccaagctgtgccctgaccaccctgggcccctgtcgtcaggacctcctgaggctttggcaaataaacctcctaaaatgatacaaacgtgtcagttttctcagttgaca

SEQ ID NO: 4648 - DNA, 1385 bp, synthetic construct
  misc_feature 1..1385: note = Synthetic polypeptide
  source 1..1385: mol_type = other DNA
atggatttcggactggccctcctgctggcggggcttctggggctcctcctcggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgtcctgcacagcccgacctccccggagcctcccgacaccacctccccggagtctcccgacaccacctccccggagtctcccgacaccacctcccaggagcctcccgacaccacctccccggagcctcccgacaagacctccccggagcccgccccccagcagggctccacacacacccccaggagcccaggctccaccaggactcgccgccctgagatctcccaggctgggcccacgcagggagaagtgatcccaacaggctcgtccaaacctgcgggtgaccagctgcccgcggctctgtggaccagcagtgcggtgctgggactgctgctcctggccttgcccacctatcacctctggaaacgctgccggcacctggctgaggacgacacccacccaccagcttctctgaggcttctgccccagagatggatgcatgttctgattgcctctttggagaagctcatcagaaactcaaaagaaggccactgtttgtctcacctacccatgacctgaagcccctccctgagtggtccccacctttctggacggaaccacgtactttttacatacattgattcatgtctcacgtctccctaaaaatgcgtaagaccaagctgtgccctgaccaccctgggcccctgtcgtcaggacctcctgaggctttggcaaataaacctcctaaaatgatacaaacgtgtcagttttctcagttgaca

SEQ ID NO: 4649 - DNA, 1124 bp, synthetic construct
  misc_feature 1..1124: note = Synthetic polypeptide
  source 1..1124: mol_type = other DNA
atggatttcggactggccctcctgctggcggggcttctggggctcctcctcggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgcgtccaaacctgcgggtgaccagctgcccgcggctctgtggaccagcagtgcggtgctgggactgctgctcctggccttgcccacctatcacctctggaaacgctgccggcacctggctgaggacgacacccacccaccagcttctctgaggcttctgccccagagatggatgcatgttctgattgcctctttggagaagctcatcagaaactcaaaagaaggccactgtttgtctcacctacccatgacctgaagcccctccctgagtggtccccacctttctggacggaaccacgtactttttacatacattgattcatgtctcacgtctccctaaaaatgcgtaagaccaagctgtgccctgaccaccctgggcccctgtcgtcaggacctcctgaggctttggcaaataaacctcctaaaatgatacaaacgtgtcagttttctcagttgaca

SEQ ID NO: 4650 - DNA, 839 bp, synthetic construct
  misc_feature 1..839: note = Synthetic polypeptide
  source 1..839: mol_type = other DNA
atggatttcggactggccctcctgctggcggggcttctggggctcctcctcgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgcgtccaaacctgcgggtgaccagctgcccgcggctctgtggaccagcagtgcggtgctgggactgctgctcctggccttgcccacctatcacctctggaaacgctgccggcacctggctgaggacgacacccacccaccagcttctctgaggcttctgccccagagatggatgcatgttctgattgcctctttggagaagctcatcagaaactcaaaagaaggccactgtttgtctcacctacccatgacctgaagcccctccctgagtggtccccacctttctggacggaaccacgtactttttacatacattgattcatgtctcacgtctccctaaaaatgcgtaagaccaagctgtgccctgaccaccctgggcccctgtcgtcaggacctcctgaggctttggcaaataaacctcctaaaatgatacaaacgtgtcagttttctcagttgaca

SEQ ID NO: 4651 - DNA, 979 bp, synthetic construct
  misc_feature 1..979: note = Synthetic polypeptide
  source 1..979: mol_type = other DNA
atgtgcggacctgacgacagatgccccgcacgctggccgggaccgggaagggcggtcaagtgtggaaagggtctggcggctgccaggcctggcagagtggagcggggcggggcgcagcggggcggggcgggcctggagctgcacccgcttctgggtggacgcacttggcgagcggcgcgggatgcagacggctgcgaggcgctgggcacagttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccacccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttcctcgagggaggcaagaagagctggagattaagtcaatcaccaatgagcaatgatttaataaaccatgcctataaaatggagtctccataaaaaccctaaataacagggtttggagaggttccaagtcagtgaatgcatccacatggtaggagggtggtgcatcccaaactccaggggacagcagctcctgtgctcaggaccctttgggaccttgcccggtgtccctcttcatctggctgttcat

SEQ ID NO: 4652 - DNA, 850 bp, synthetic construct
  misc_feature 1..850: note = Synthetic polypeptide
  source 1..850: mol_type = other DNA
atgcacatgagagagacaagtggcttcacattgaagaaggggaggagtgcgccattggttttccatcctccagatgcactgattgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccacccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttcctcgagggaggcaagaagagctggagattaagtcaatcaccaatgagcaatgatttaataaaccatgcctataaaatggagtctccataaaaaccctaaataacagggtttggagaggttccaagtcagtgaatgcatccacatggtaggagggtggtgcatcccaaactccaggggacagcagctcctgtgctcaggaccctttgggaccttgcccggtgtccctcttcatctggctgttcat

SEQ ID NO: 4653 - DNA, 787 bp, synthetic construct
  misc_feature 1..787: note = Synthetic polypeptide
  source 1..787: mol_type = other DNA
atgggacctgcgggggaggttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccacccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttcctcgagggaggcaagaagagctggagattaagtcaatcaccaatgagcaatgatttaataaaccatgcctataaaatggagtctccataaaaaccctaaataacagggtttggagaggttccaagtcagtgaatgcatccacatggtaggagggtggtgcatcccaaactccaggggacagcagctcctgtgctcaggaccctttgggaccttgcccggtgtccctcttcatctggctgttcat

SEQ ID NO: 4654 - DNA, 808 bp, synthetic construct
  misc_feature 1..808: note = Synthetic polypeptide
  source 1..808: mol_type = other DNA
atgaatccattcctgatccttgcctttgtgggagctgctgttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccacccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttcctcgagggaggcaagaagagctggagattaagtcaatcaccaatgagcaatgatttaataaaccatgcctataaaatggagtctccataaaaaccctaaataacagggtttggagaggttccaagtcagtgaatgcatccacatggtaggagggtggtgcatcccaaactccaggggacagcagctcctgtgctcaggaccctttgggaccttgcccggtgtccctcttcatctggctgttcat

SEQ ID NO: 4655 - DNA, 934 bp, synthetic construct
  misc_feature 1..934: note = Synthetic polypeptide
  source 1..934: mol_type = other DNA
atgataaggacgctgctgctgtccactttggtggctggagccctcagttgtggggaccccacttacccaccttatgtgactagggtggttggcggtgaagaagcgaggcccaacagctggccctggcaggtctccctgcagtacagctccaatggcaagtggtaccacacctgcggagggtccctgatagccaacagctgggtcctgacggctgcccactgcatcagctcctccaggacctaccgcgtggggctgggccggcacaacctctacgttgcggagtccggctcgctggcagtcagtgtctctaagattgtggtgcacaaggactggaactccaaccaaatctccaaagggaacgacattgccctgctcaaactggctaaccccgtctccctcaccgacaagatccagctggcctgcctccctcctgccggcaccattctacccaacaactacccctgctacgtcacgggctggggaaggctgcagaccaacggggctgttcctgatgtcctgcagcagggccggttgctggttgtggactatgccacctgctccagctctgcctggtggggcagcagcgtgaaaaccagtatgatctgtgctgggggtgatggcgtgatctccagctgcaacggagactctggcgggccactgaactgtcaggcgtctgacggccggtggcaggtgcacggcatcgtcagcttcgggtctcgcctcggctgcaactactaccacaagccctccgtcttcacgcgggtctccaattacatcgactggatcaattcgctactcaggaggctgaggcaggggaatcacttgaacctgggaggtggaggttgcagtaacccgagttcgcaccactgcactccagcctgggcgacagagcgagactccatctcaaaagaaaaaaaaacacacaaaaaagaaa

SEQ ID NO: 4656 - DNA, 506 bp, synthetic construct; identical to SEQ ID NO: 1096
  misc_feature 1..506: note = Synthetic polypeptide
  source 1..506: mol_type = other DNA

SEQ ID NO: 4657 - DNA, 285 bp, synthetic construct; identical to SEQ ID NO: 1623
  misc_feature 1..285: note = Synthetic polypeptide
  source 1..285: mol_type = other DNA

SEQ ID NO: 4658 - DNA, 197 bp, synthetic construct; identical to SEQ ID NO: 3411
  misc_feature 1..197: note = Synthetic polypeptide
  source 1..197: mol_type = other DNA

SEQ ID NO: 4659 - DNA, 2151 bp, synthetic construct; identical to SEQ ID NO: 127
  misc_feature 1..2151: note = Synthetic polypeptide
  source 1..2151: mol_type = other DNA

SEQ ID NO: 4660 - DNA, 1833 bp, synthetic construct; identical to SEQ ID NO: 126
  misc_feature 1..1833: note = Synthetic polypeptide
  source 1..1833: mol_type = other DNA

SEQ ID NO: 4661 - DNA, 681 bp, synthetic construct; identical to SEQ ID NO: 911
  misc_feature 1..681: note = Synthetic polypeptide
  source 1..681: mol_type = other DNA

SEQ ID NO: 4662 - DNA, 285 bp, synthetic construct; identical to SEQ ID NO: 1623
  misc_feature 1..285: note = Synthetic polypeptide
  source 1..285: mol_type = other DNA

SEQ ID NO: 4663 - DNA, 4024 bp, synthetic construct; identical to SEQ ID NO: 1712
  misc_feature 1..4024: note = Synthetic polypeptide
  source 1..4024: mol_type = other DNA

SEQ ID NO: 4664 - DNA, 4060 bp, synthetic construct; identical to SEQ ID NO: 1713
  misc_feature 1..4060: note = Synthetic polypeptide
  source 1..4060: mol_type = other DNA

SEQ ID NO: 4665 - DNA, 2267 bp, synthetic construct; identical to SEQ ID NO: 2277
  misc_feature 1..2267: note = Synthetic polypeptide
  source 1..2267: mol_type = other DNA

SEQ ID NO: 4666 - DNA, 2264 bp, synthetic construct; identical to SEQ ID NO: 2278
  misc_feature 1..2264: note = Synthetic polypeptide
  source 1..2264: mol_type = other DNA

SEQ ID NO: 4667 - DNA, 731 bp, synthetic construct; identical to SEQ ID NO: 2279
  misc_feature 1..731: note = Synthetic polypeptide
  source 1..731: mol_type = other DNA

SEQ ID NO: 4668 - DNA, 1565 bp, synthetic construct; identical to SEQ ID NO: 2280
  misc_feature 1..1565: note = Synthetic polypeptide
  source 1..1565: mol_type = other DNA

SEQ ID NO: 4669 - DNA, 1528 bp, synthetic construct
  misc_feature 1..1528: note = Synthetic polypeptide
  source 1..1528: mol_type = other DNA
atgcccgccctcagtcgctgggccagcctgcccggccccagcatgcgggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgggatgtccgaccgtggcgagcttgagaacgcagatctcgtggtgctctggaccgatggggacactgcctattttgcggacgcctggagtgaccagaaggggcagatccacctggatccccagcaggactaccagctgctgcaggtgcagaggaccccagaaggcctgaccctgcttttcaagaggccctttggcacctgcgaccccaaggattacctcattgaagacggcactgtccacttggtctacgggatcctggaggagccgttccggtcactggaggccatcaacggctcgggcctgcagatggggctgcagagggtgcagctcctgaagcccaatatccccgaaccggagttgccctcagacgcgtgcaccatggaggtccaagctcccaatatccagatccccagccaggagaccacgtactggtgctacattaaggagcttccaaagggcttctctcggcaccacattatcaagtacgagcccatcgtcaccaagggcaatgaggcccttgtccaccacatggaagtcttccagtgcgcccccgagatggacagcgtcccccacttcagcgggccctgcgactccaagatgaaacccgaccgcctcaactactgccgccacgtgctggccgcctgggccctgggtgccaaggcattttactacccagaggaagccggccttgccttcgggggtccagggtcctccagatatctccgcctggaagttcactaccacaacccactggtgatagaaggacgaaacgactcctcaggcatccgcttgtactacacagccaagctgcggcgcttcaacgcggggatcatggagctgggactggtgtacacgccagtgatggccattccaccacgggagaccgccttcatcctcactggctactgcacggacaagtgcacccagctggcactgcctccctccgggatccacatcttcgcctctcagctccacacacacctgactgggagaaaggtggtcacagtgctggtccgggacggccgggagtgggagatcgtgaaccaggacaatcactacagccctcacttccaggagatccgcatgttgaagaaggtcgtgtcggtccatccgggagatgtgctcatcacctcctgcacgtacaacacagaagaccgggagctggccacagtgcatcatcagtacctgatacgaatttcctggttgactcactcactcactgcctgtctctcctgccaatggtggcaattccttgagggcagggact

SEQ ID NO: 4670 - DNA, 1034 bp, synthetic construct
  misc_feature 1..1034: note = Synthetic polypeptide
  source 1..1034: mol_type = other DNA
atgcacctgcagatgcgggaggacatggctaagtacagacgaatgtcgggagttcggccccagagcttccgggacctggagacgcccccacactgggcagcctatgacactggcctggagctactggggcgccaggaggcaggactggcactgcccaggctagaggaggctcttcaggggagcctggcccagatggagagctgccgtgctgactgtgaggggcctgaggagcagcagggggctgaagaagaggaggatggggctgcgagccaggggggcctctatgaggccattgcaggacactggattcaggtcctgcagtgccggcaacgctgtgtgggggaaacagccacacgccctggtcgcagcttccctgtcccagacttccttcccaaccagctgaggcggctacatgaggcccatgctcaggtgggcaatctgtcccaggctatagaaaatgtcctgagtgtcctgctcttctacccggaggatgaggctgccaagagggctctgaaccagtaccaggcccagctgggagagccgagacctggcctcggacccagagaggacatccagcgcttcatcctccgatccctgggggagaagaggcagctctactatgccatggagcacctggggaccagcttcaaggatcctgacccctggacccctgcagctctcatccctgaggcacttagagaaaagctcagagaggatcaagagaagaggccttgggaccatgagcccgtgaagccaaagcccttgacctactggaaggatgtccttctcctggagggtgtgaccttgacccaggattccaggcagctgaatgggtcggagcgggcggtgttggatgggctgctcaccccagccgagtgtggggtgctgctgcagctggctaaggtactcgggaggctgaggcaggagaagcgcctgaacccgggaggcggaggttgtggtgagctgatctcgtgccattgcactccagcgtgggcaacaagagcgaaactccatctcaaaaaaaaaaaaaaaaa

SEQ ID NO: 4671 - DNA, 1586 bp, synthetic construct
  misc_feature 1..1586: note = Synthetic polypeptide
  source 1..1586: mol_type = other DNA
atgctccggctcctccggccgctgctgctactgctgctgctgcctcccccggggtcccctgagccccccggcctgacccagctgtccccgggggcgcccccgcaggcccccgacttgctctacgctgacgggctgcgcgcctacgcggccggggcttgggcgccggccgtggcgctgctgcgggaggcgctgcggagccaggcggcgctgggccgggtgcggctggattgcggggcgagctgcgcggccgatccgggcgccgcgctccccgccgtgcttctcggggccccggagcccgactccgggccgggacccacgcaggggtcctgggagcgacagcttctccgtgcagcgctccgccgcgcagactgcctgacccagtgcgcagcacggaggctgggccccgggggcgcggcgcgccgcgtggggagcgcgctccgggacgccttccgccgtcgggagccctacaactacctgcagagggcctattaccagttgaagaagctggatctggcagctgcggcagcacacaccttctttgtagcaaaccccatgcacctgcagatgcgggaggacatggctaagtacagacgaatgtcgggagttcggccccagagcttccgggacctggagacgcccccacactgggcagcctatgacactggcctggagctactggggcgccaggaggcaggactggcactgcccaggctagaggaggctcttcaggggagcctggcccagatggagagctgccgtgctgactgtgaggggcctgaggagcagcagggggctgaagaagaggaggatggggctgcgagccaggggggcctctatgaggccattgcaggacactggattcaggtcctgcagtgccggcaacgctgtgtgggggaaacagccacacgccctggtcgcagcttccctgtcccagacttccttcccaaccagctgaggcggctacatgaggcccatgctcaggtgggcaatctgtcccaggctatagaaaatgtcctgagtgtcctgctcttctacccggaggatgaggctgccaagagggctctgaaccagtaccaggcccagctgggagagccgagacctggcctcggacccagagaggacatccagcgcttcatcctccgatccctgggggagaagaggcagctctactatgccatggagcacctggggaccagcttcaaggatcctgacccctggacccctgcagctctcatccctgaggcacttagagaaaagctcagagaggatcaagagaagaggccttgggaccatgagcccgtgaagccaaagcccttgacctactggaaggatgtccttctcctggagggtgtgaccttgacccaggattccaggcagctgaatgggtcggagcgggcggtgttggatgggctgctcaccccagccgagtgtggggtgctgctgcagctggctaaggtactcgggaggctgaggcaggagaagcgcctgaacccgggaggcggaggttgtggtgagctgatctcgtgccattgcactccagcgtgggcaacaagagcgaaactccatctcaaaaaaaaaaaaaaaaa

SEQ ID NO: 4672 - DNA, 1588 bp, synthetic construct
  misc_feature 1..1588: note = Synthetic polypeptide
  source 1..1588: mol_type = other DNA
atgctccggctcctccggccgctgctgctactgctgctgctgcctcccccggggtcccctgagccccccggcctgacccagctgtccccgggggcgcccccgcaggcccccgacttgctctacgctgacgggctgcgcgcctacgcggccggggcttgggcgccggccgtggcgctgctgcgggaggcgctgcggagccaggcggcgctgggccgggtgcggctggattgcggggcgagctgcgcggccgatccgggcgccgcgctccccgccgtgcttctcggggccccggagcccgactccgggccgggacccacgcaggggtcctgggagcgacagcttctccgtgcagcgctccgccgcgcagactgcctgacccagtgcgcagcacggaggctgggccccgggggcgcggcgcgcttcgcgtggggagcgcgctccgggacgccttccgccgtcgggagccctacaactacctgcagagggcctattaccagttgaagaagctggatctggcagctgcggcagcacacaccttctttgtagcaaaccccatgcacctgcagatgcgggaggacatggctaagtacagacgaatgtcgggagttcggccccagagcttccgggacctggagacgcccccacactgggcagcctatgacactggcctggagctactggggcgccaggaggcaggactggcactgcccaggctagaggaggctcttcaggggagcctggcccagatggagagctgccgtgctgactgtgaggggcctgaggagcagcagggggctgaagaagaggaggatggggctgcgagccaggggggcctctatgaggccattgcaggacactggattcaggtcctgcagtgccggcaacgctgtgtgggggaaacagccacacgccctggtcgcagcttccctgtcccagacttccttcccaaccagctgaggcggctacatgaggcccatgctcaggtgggcaatctgtcccaggctatagaaaatgtcctgagtgtcctgctcttctacccggaggatgaggctgccaagagggctctgaaccagtaccaggcccagctgggagagccgagacctggcctcggacccagagaggacatccagcgcttcatcctccgatccctgggggagaagaggcagctctactatgccatggagcacctggggaccagcttcaaggatcctgacccctggacccctgcagctctcatccctgaggcacttagagaaaagctcagagaggatcaagagaagaggccttgggaccatgagcccgtgaagccaaagcccttgacctactggaaggatgtccttctcctggagggtgtgaccttgacccaggattccaggcagctgaatgggtcggagcgggcggtgttggatgggctgctcaccccagccgagtgtggggtgctgctgcagctggctaaggtactcgggaggctgaggcaggagaagcgcctgaacccgggaggcggaggttgtggtgagctgatctcgtgccattgcactccagcgtgggcaacaagagcgaaactccatctcaaaaaaaaaaaaaaaaa

SEQ ID NO: 4673 - DNA, 500 bp, synthetic construct; identical to SEQ ID NO: 919
  misc_feature 1..500: note = Synthetic polypeptide
  source 1..500: mol_type = other DNA

SEQ ID NO: 4674 - DNA, 1063 bp, synthetic construct; identical to SEQ ID NO: 2221
  misc_feature 1..1063: note = Synthetic polypeptide
  source 1..1063: mol_type = other DNA

SEQ ID NO: 4675 - DNA, 581 bp, synthetic construct
  misc_feature 1..581: note = Synthetic polypeptide
  source 1..581: mol_type = other DNA
atggccgggccgggctcgccgcgccgcgcgtcccggggggcctcggcgcttctcgctgccgcgcttctctacgccgcgctgggggacgtggtgcgctcggagcagcagataccgctctccgtggtgaagctctgggcctcggcttttggtggggagataaaatccattgctgctaagtactccggttcccagcttctgcaaaaggtatacactgcaaaagaacagaaagaagagactgaaatagagactggcacaacaatgttcttagcaggattatccacaatagccaaaggtggaaacagcccgaatgtgcatcaacagatgagtgaattaataaaatgtgatatatgcatacaatggaattttcaaccataaaaaggaatgaatttttcatacatgctacaacatggataagccttgaaaacataatgcaaagtgaaataaatcagacacaaaaggacaaacattgtgtgattctacttatacgaagtacctggaataggcgaattcctagagacagaaagtagaatagaggttaccaggaactgagtggaggggagaatggggtattatttttttat

SEQ ID NO: 4676 - DNA, 394 bp, synthetic construct; identical to SEQ ID NO: 3032
  misc_feature 1..394: note = Synthetic polypeptide
  source 1..394: mol_type = other DNA

SEQ ID NO: 4677 - DNA, 410 bp, synthetic construct; identical to SEQ ID NO: 2219
  misc_feature 1..410: note = Synthetic polypeptide
  source 1..410: mol_type = other DNA

SEQ ID NO: 4678 - DNA, 392 bp, synthetic construct; identical to SEQ ID NO: 2220
  misc_feature 1..392: note = Synthetic polypeptide
  source 1..392: mol_type = other DNA

SEQ ID NO: 4679 - DNA, 2142 bp, synthetic construct
  misc_feature 1..2142: note = Synthetic polypeptide
  source 1..2142: mol_type = other DNA
atgcagccaacgctgcttctcagcctcctgggagccgtggggctggcggctgtcaattccatgccagtggataacaggaaccacaatgaaggaatggtgactcgctgcatcattgaggtcctctcaaatgccttgtcgaagtccagcgctccacccatcacccctgagtgccgccaagtcctgaagacgagtagaaaagacgtcaaagacaaagagacaactgaaaatgaaaacacaaagtttgaagtaagattgttaagagacccagctgatgcctcggaagcccacgagtcctccagcaggggagaggcaggagccccaggggaggaggacatccaaggcccaacaaaggcagacacagagaaatgggcagagggaggcgggcacagccgagagcgagcggatgagccccagtggagcctctatccctccgacagccaagtctctgaagaagtgaagacacgccattctgagaagagccagagagaggatgaggaggaggaggagggagagaactatcaaaaaggggagcgaggggaagatagcagtgaagagaaacaccttgaagagccaggagagacacaaaacgcttttctcaatgaaagaaagcaggcttcagctataaaaaaagaggagttagtggccagatcggaaacacatgctgccgggcattctcaggagaagacacatagccgagagaagagtagccaggagagtggagaggagacagggagccaggagaatcacccccaggagtctaaaggccaaccccgaagccaggaagaatctgaggaaggtgaggaagatgccacctctgaggtggacaaacgacgcacgaggcccagacaccaccacgggaggagcaggcccgacaggtcctctcaaggagggagtcttccctctgaggaaaagggacacccccaggaggaatctgaggagtcaaacgtcagcatggccagtttaggggaaaagagggaccaccattcaacccactacagggcttcagaggaagaacctgaatatggagaagaaataaagggttatccaggcgtccaggcccctgaggacctggagtgggagcgctataggggcagaggaagtgaagaatacagggctccaagacctcagagtgaggagagttgggatgaggaggacaagagaaactaccccagcttagagcttgataagatggcacatggatatggtgaagaaagtgaggaagagaggggccttgagccgggaaagggacgccatcacagaggcaggggaggggagccacgtgcctatttcatgtctgacaccagagaagagaaaaggttcttgggtgaaggacaccaccgtgtccaagaaaaccagatggacaaggcaaggaggcatccacaaggtgcgtggaaagagctggacagaaattatctcaactacggtgaggaaggagccccagggaagtggcagcagcagggagacctgcaggacactaaagaaaacagggaggaagctaggtttcaagataaacaatatagctcccatcacacagctgaaaagaggaagagattaggggaactgttcaacccatactacgaccctctccagtggaagagcagccattttgaaagaagagacaacatgaatgacaattttctcgagggtgaggaggaaaatgagctgaccttgaacgagaagaatttcttcccagaatacaactatgactggtgggagaaaaagcccttctctgaggatgtgaactgggggtatgagaagagaaacctcgccagggtccccaagctggacctgaaaaggcaatatgacagggtggcccaactggaccagctccttcactacaggaagaagtcagctgagtttccagacttctatgattctgaggagccggccagcacccacccccctcaggtggagagacactgaggcacatattctgcactgcctcccagacttcctctgtggatcatgccccaggtgccacagcagtgacctgcccaataatgcagcctttattggctgcctttaccttttccactgcccactggtgaccctgctggtgtttcctgggatcatctctcatataaactgcttgttttcaaatacttgtctcagggtttgctcctgggggaccctgacctaaga

SEQ ID NO: 4680 - DNA, 1180 bp, synthetic construct; identical to SEQ ID NO: 1340
  misc_feature 1..1180: note = Synthetic polypeptide
  source 1..1180: mol_type = other DNA

SEQ ID NO: 4681 - DNA, 607 bp, synthetic construct; identical to SEQ ID NO: 2299
  misc_feature 1..607: note = Synthetic polypeptide
  source 1..607: mol_type = other DNA

SEQ ID NO: 4682 - DNA, 577 bp, synthetic construct; identical to SEQ ID NO: 2300
  misc_feature 1..577: note = Synthetic polypeptide
  source 1..577: mol_type = other DNA

SEQ ID NO: 4683 - DNA, 604 bp, synthetic construct; identical to SEQ ID NO: 2301
  misc_feature 1..604: note = Synthetic polypeptide
  source 1..604: mol_type = other DNA

SEQ ID NO: 4684 - DNA, 226 bp, synthetic construct
  misc_feature 1..226: note = Synthetic polypeptide
  source 1..226: mol_type = other DNA
atgagacagagcggcgcctcccagcccctgctgatcaacatgtacctgccagatcccgtcggagacggtctcttcaaggacgggaagaacccgagctgggggccgctgagccccgcggttcagaaagggcgcccggctgagatggagagtggcggcggatatctgtccttgctcgccttggaaagccaagtgccttggtgcgccgctgcgctcacgtggggggagg

SEQ ID NO: 4685 - DNA, 1913 bp, synthetic construct; identical to SEQ ID NO: 3276
  misc_feature 1..1913: note = Synthetic polypeptide
  source 1..1913: mol_type = other DNA

SEQ ID NO: 4686 - DNA, 2460 bp, synthetic construct; identical to SEQ ID NO: 3277
  misc_feature 1..2460: note = Synthetic polypeptide
  source 1..2460: mol_type = other DNA

SEQ ID NO: 4687 - DNA, 1394 bp, synthetic construct
  misc_feature 1..1394: note = Synthetic polypeptide
  source 1..1394: mol_type = other DNA
atgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgttccagctattcgggaggatgaggcaggagaatcgcttgaacccaggaggtggaggttgcagtgagccgagattgcaccactgcgctccagctt

SEQ ID NO: 4688 - DNA, 1367 bp, synthetic construct
  misc_feature 1..1367: note = Synthetic polypeptide
  source 1..1367: mol_type = other DNA
atgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgttccagctattcgggaggatgaggcaggagaatcgcttgaacccaggaggtggaggttgcagtgagccgagattgcaccactgcgctccagctt

SEQ ID NO: 4689 - DNA, 1370 bp, synthetic construct
  misc_feature 1..1370: note = Synthetic polypeptide
  source 1..1370: mol_type = other DNA
atgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgttccagctattcgggaggatgaggcaggagaatcgcttgaacccaggaggtggaggttgcagtgagccgagattgcaccactgcgctccagctt

SEQ ID NO: 4690 - DNA, 1505 bp, synthetic construct
  misc_feature 1..1505: note = Synthetic polypeptide
  source 1..1505: mol_type = other DNA
atgcagatccggttattaagagccgagctggtggttcccctctggcaattcatcaggcagtggccccctgggagtgatggatggggacaaatggaggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgttccagctattcgggaggatgaggcaggagaatcgcttgaacccaggaggtggaggttgcagtgagccgagattgcaccactgcgctccagctt

SEQ ID NO: 4691 - DNA, 1511 bp, synthetic construct
  misc_feature 1..1511: note = Synthetic polypeptide
  source 1..1511: mol_type = other DNA
atgggcgggaagggaggaggggacacgagaggccctgtcctcttcccgtgccagcttgctcaggccctcagtcccagacgggcttttcccagagagctaaaagagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgttccagctattcgggaggatgaggcaggagaatcgcttgaacccaggaggtggaggttgcagtgagccgagattgcaccactgcgctccagctt

SEQ ID NO: 4692 - DNA, 1439 bp, synthetic construct
  misc_feature 1..1439: note = Synthetic polypeptide
  source 1..1439: mol_type = other DNA
atggactctcaaggggactgggctgcacaggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgttccagctattcgggaggatgaggcaggagaatcgcttgaacccaggaggtggaggttgcagtgagccgagattgcaccactgcgctccagctt

SEQ ID NO: 4693 - DNA, 1524 bp, synthetic construct
  misc_feature 1..1524: note = Synthetic polypeptide
  source 1..1524: mol_type = other DNA
atgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagaatggctgcagtggaggactggctcctgctccccagaatccttgtcatcaagagggacaactaccagcttgggacagcgggaagaccctggcctggccttggtcatttagggtcctgctggcccttttcctgggccccttgggagggaggagggctcccgggcctgagtggtgctgttcaccatactccttcctttgaggactacaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgttccagctattcgggaggatgaggcaggagaatcgcttgaacccaggaggtggaggttgcagtgagccgagattgcaccactgcgctccagctt

SEQ ID NO: 4694 - DNA, 734 bp, synthetic construct; identical to SEQ ID NO: 930
  misc_feature 1..734: note = Synthetic polypeptide
  source 1..734: mol_type = other DNA

SEQ ID NO: 4695 - DNA, 2800 bp, synthetic construct
  misc_feature 1..2800: note = Synthetic polypeptide
  source 1..2800: mol_type = other DNA
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggcgtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgatttactctccaactttctccagttactgtatgtttcaaagagtgaacctccaaagagtgaatcaatgggcttgcttgctctctggcttccaggtgaattcagccagtggaaccatggcaggagatcagagggaggaaatacaatgagatcaaggaatgtatttccatggtttcttccctgcagcatcacagcagtgggcatgtacctttcccagacctcttacctcttattacactactctctccatagagctctcttttacctaggtctccaataaccattccttctcctttcctcttcaaggttaggggtagtaacattatcccactttttctgcctcgagattattaaagttttccttatgtttttgctggacacccctcctttgtaaagagtatgtcactttattaaactcaaatgaaacccaatttgtgctatctcttttccaacaagatcatgacttatata

SEQ ID NO: 4696 - DNA, 605 bp, synthetic construct
  misc_feature 1..605: note = Synthetic polypeptide
  source 1..605: mol_type = other DNA
tgtagctggtgtggttgctggaattgttcttattggccttgcattactgctgatatggaagcttttaatgataattcatgacagaagggagtttgctaaatttgaaaaggagaaaatgaatgccaaatgggacacgatttactctccaactttctccagttactgtatgtttcaaagagtgaacctccaaagagtgaatcaatgggcttgcttgctctctggcttccaggtgaattcagccagtggaaccatggcaggagatcagagggaggaaatacaatgagatcaaggaatgtatttccatggtttcttccctgcagcatcacagcagtgggcatgtacctttcccagacctcttacctcttattacactactctctccatagagctctcttttacctaggtctccaataaccattccttctcctttcctcttcaaggttaggggtagtaacattatcccactttttctgcctcgagattattaaagttttccttatgtttttgctggacacccctcctttgtaaagagtatgtcactttattaaactcaaatgaaacccaatttgtgctatctcttttccaacaagatcatgacttatata

SEQ ID NO: 4697 - DNA, 1447 bp, synthetic construct
  misc_feature 1..1447: note = Synthetic polypeptide
  source 1..1447: mol_type = other DNA
atggccgggccgggctcgccgcgccgcgcgtcccggggggcctcggcgcttctcgctgccgcgcttctctacgccgcgctgggggacgtggtgcgctcggagcagcagataccgctctccgtggtgaagctctgggcctcggcttttggtggggagataaaatccattgctgctaagtactccggttcccagcttctgcaaaagaaatacaaagagtatgagaaagacgttgccatagaagaaattgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggtacatggtccagacagaacagtcacgagatgcagcagccttcatcagcctgggtccctgagtgagcacatggagcagatgactttcactgccccttgcatctgccaacccacactggattataaatagtgttcatgacaaataaacttttatgttaagccactgagatttttagtttgatatgttcttatagcataactt

SEQ ID NO: 4698 - DNA, 1165 bp, synthetic construct
  misc_feature 1..1165: note = Synthetic polypeptide
  source 1..1165: mol_type = other DNA
atggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggtacatggtccagacagaacagtcacgagatgcagcagccttcatcagcctgggtccctgagtgagcacatggagcagatgactttcactgccccttgcatctgccaacccacactggattataaatagtgttcatgacaaataaacttttatgttaagccactgagatttttagtttgatatgttcttatagcataactt

SEQ ID NO: 4699 - DNA, 1105 bp, synthetic construct
  misc_feature 1..1105: note = Synthetic polypeptide
  source 1..1105: mol_type = other DNA
atgcagcaggagggaggacccgtgaggagcgccccctgtaggaccggaaccctggagggttcgcggcaagggtctccggggcataggaaacgggcatcccccaagggtagtctgagttccgcccagccccattcctggatgctcacgccgtctcccctaaactcccactgcgctcaccgggagcccatctcatcatcaccacagcccgtggctaatgggccaaaacagaagaagaaaagcaactggcggagtacaacgcgcctgcgcattatcagactcagggacaggctggaacctcgccccctagctatcctagaagactatgcggacccgtttgatgttcaggagactggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccgcggaaggtgagggggccccctggccccgggagtcccgcctgccagaggatgatgagaggccccctgaggagtatgaccagccctgggagtggaagaaggagcggatttccaaagcctttgcagttgacattaaggtcatcaaagacctaccttggcctccacctgtgggacagctggacagcagcccctccctgcctgatggggacagggacatctccggtccagcctcgcccctccctgagcccagcctggaggacagcagcgcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccaggtctggtatcacggggccatcagccgaaccgacgccgagaacctgctccggctgtgcaaagaggccagctacctggtgcgcaacagtgagaccagcaagaatgacttctccctctccctcaactgtcatactctaggagtct

SEQ ID NO: 4700 - DNA, 1135 bp, synthetic construct
  misc_feature 1..1135: note = Synthetic polypeptide
  source 1..1135: mol_type = other DNA
atggtggcccaaagtctctctgacgctcaccatgccctgactatcatgctatctgaacgactttggctgggactggagctcttaaattttacaagaaggaaaatcagttctgacccaccaccatacaacttccttgaggcgcgagaggcggcattgggtcaccgctggaggatgcagcaggagggaggacccgtgaggagcgccccctgtaggaccggaaccctggagggttcgcggcaagggtctccggggcataggaaacgggcatcccccaagggtagtctgagttccgcccagccccattcctggatgctcacgccgtctcccctaaactcccactgcgctcaccgggagcccatctcatcatcaccacagcccgtggctaatgggccaaaacagaagaagaaaagcaactggcggagtacaacgcgcctgcgcattatcagactcagggacaggctggaacctcgccccctagctatcctagaagactatgcggacccgtttgatgttcaggagactggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccgcggaaggtgagggggccccctggccccgggagtcccgcctgccagaggatgatgagaggccccctgaggagtatgaccagccctgggagtggaagaaggagcggatttccaaagcctttgcagcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccaggtctggtatcacggggccatcagccgaaccgacgccgagaacctgctccggctgtgcaaagaggccagctacctggtgcgcaacagtgagaccagcaagaatgacttctccctctccctcaactgtcatactctaggagtct

SEQ ID NO: 4701 - DNA, 553 bp, synthetic construct
  misc_feature 1..553: note = Synthetic polypeptide
  source 1..553: mol_type = other DNA
atggagccctatgaggctcaaaagatgatggccgagatccggggctccaaggagacagcaactcagcccttgcctctgtatgacacaccctatgagccagaggaggatggggccaccgcggaaggtgagggggccccctggccccgggagtcccgcctgccagaggatgatgagaggccccctgaggagtatgaccagccctgggagtggaagaaggagcggatttccaaagcctttgcagcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccaggtctggtatcacggggccatcagccgaaccgacgccgagaacctgctccggctgtgcaaagaggccagctacctggtgcgcaacagtgagaccagcaagaatgacttctccctctccctcaactgtcatactctaggagtct

SEQ ID NO: 4702 - DNA, 324 bp, synthetic construct
  misc_feature 1..324: note = Synthetic polypeptide
  source 1..324: mol_type = other DNA
ccccctggccccgggagtcccgcctgccagaggatgatgagaggccccctgaggagtatgaccagccctgggagtggaagaaggagcggatttccaaagcctttgcaggggacacccacaatgggtgggcctggacagcgagggacccagcagagatgccccccttcctctctctcatccttagctggtatcacggggccatcagccgaaccgacgccgagaacctgctccggctgtgcaaagaggccagctacctggtgcgcaacagtgagaccagcaagaatgacttctccctctccctcaactgtcatactctaggagtct

SEQ ID NO: 4703 - DNA, 615 bp, synthetic construct
  misc_feature 1..615: note = Synthetic polypeptide
  source 1..615: mol_type = other DNA
ctggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccgcggaaggtgagggggccccctggccccgggagtcccgcctgccagaggatgatgagaggccccctgaggagtatgaccagccctgggagtggaagaaggagcggatttccaaagcctttgcagcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccaggtctggtatcacggggccatcagccgaaccgacgccgagaacctgctccggctgtgcaaagaggccagctacctggtgcgcaacagtgagaccagcaagaatgacttctccctctccctcaactgtcatactctaggagtct

SEQ ID NO: 4704 - DNA, 2648 bp, synthetic construct; identical to SEQ ID NO: 3730
  misc_feature 1..2648: note = Synthetic polypeptide
  source 1..2648: mol_type = other DNA

SEQ ID NO: 4705 - DNA, 2636 bp, synthetic construct; identical to SEQ ID NO: 3731
  misc_feature 1..2636: note = Synthetic polypeptide
  source 1..2636: mol_type = other DNA

SEQ ID NO: 4706 - DNA, 565 bp, synthetic construct; identical to SEQ ID NO: 3732
  misc_feature 1..565: note = Synthetic polypeptide
  source 1..565: mol_type = other DNA

SEQ ID NO: 4707 - DNA, 1898 bp, synthetic construct; identical to SEQ ID NO: 2282
  misc_feature 1..1898: note = Synthetic polypeptide
  source 1..1898: mol_type = other DNA

SEQ ID NO: 4708 - DNA, 1865 bp, synthetic construct; identical to SEQ ID NO: 2283
  misc_feature 1..1865: note = Synthetic polypeptide
  source 1..1865: mol_type = other DNA

SEQ ID NO: 4709 - DNA, 764 bp, synthetic construct; identical to SEQ ID NO: 2284
  misc_feature 1..764: note = Synthetic polypeptide
  source 1..764: mol_type = other DNA

SEQ ID NO: 4710 - DNA, 746 bp, synthetic construct
  misc_feature 1..746: note = Synthetic polypeptide
  source 1..746: mol_type = other DNA
atggcagaaatggagaaagaagggagacctcccgaaaataaacggagcaggaagccggctcacccagtgaaaagggagatcaatgaggagatgaagaactttgcagaaaacaccatgaatgaactccttggctggtatggctatgataaggttgaattaaaagatggtgaggatattgaattcaggagctaccctacagatggggagagccggcagcacatttctgttctcaaagaaaattctttgccaaaaccaaaattacccgaggacagtgttatttcaccatacaatataagcacaggctattcagggcttgccactggaaatggactcagtgactcacctgcagggtcaaaggatcatggcagtgtgcccattattgtacctttaattccaccacctttcataaagccaccagcagaagatgatgtgtcaaatgtacaaataatgtgtgcctggtgccagaaagtgggaatcaagcgctattccctgagtatgggaagtgaggtgaaaagcttctgcagcgagaagtgctttgcggcctgccgacgagcctacttcaagagaaataaggctagagatgaagatggacatgctgaaaattttccccagcagcactatgctaaggaaactccaaggcttgccttcaagaataactgcgaactacttagttcatggcacatgagaaagagaaggaaggatctgctcctgtgacctgggccaagatttctagaacccagcttaaa

SEQ ID NO: 4711 - DNA, 628 bp, synthetic construct; identical to SEQ ID NO: 3106
  misc_feature 1..628: note = Synthetic polypeptide
  source 1..628: mol_type = other DNA

SEQ ID NO: 4712 - DNA, 412 bp, synthetic construct; identical to SEQ ID NO: 3107
  misc_feature 1..412: note = Synthetic polypeptide
  source 1..412: mol_type = other DNA

SEQ ID NO: 4713 - DNA, 571 bp, synthetic construct; identical to SEQ ID NO: 3108
  misc_feature 1..571: note = Synthetic polypeptide
  source 1..571: mol_type = other DNA

SEQ ID NO: 4714 - DNA, 4119 bp, synthetic construct
  misc_feature 1..4119: note = Synthetic polypeptide
  source 1..4119: mol_type = other DNA
atggccggcctccgagggaacgctgtggctggcctcctctggatgctgctgctgtggagtgggggcggcggctgccaggctcagcgggcaggttgcaaaagtgtccactacgatctggtcttcctcctggacacctcctccagcgtgggcaaggaggactttgagaaggtccggcagtgggtggccaacctggtggacaccttcgaggtgggccccgaccgcacccgtgtgggggtcgtgcgctacagcgaccggcccaccacggccttcgagttgggactctttggctcgcaggaggaggtcaaggcggctgcccggcgtctcgcctaccacgggggcaacaccaacacgggagacgcgctccgctacatcacggcccgcagcttctccccacacgccggcggccgccccagggaccgcgcctacaagcaggtggccatcctgctcaccgacggccgcagccaggacctggtgctggacgccgcggcggcagcccaccgcgctggcatccgcatctttgccgtgggcgtgggcgaggcactcaaggaggagctggaggagatcgcctcagagcccaagtccgcccacgtcttccacgtgtccgacttcaatgccatcgacaagatccggggcaagctgcggcgccgtctttgtgaaaatgtgctctgtcctagcgttcgtgtagaaggagatcgctttaagcacaccaatggaggaaccaaggaaatcacaggttttgacctgatggatttgttcagtgtgaaggaaatcttggggaagagagagaatggagctcagagttcctatgtacggatgggatccttccctgtggtgcaaagtactgaggatgtgttcccccaaggtttacctgatgagtacgcctttgtcacaaccttccggttcaggaaaacctctcggaaggaagactggtatatctggcaggtcatcgaccagtacagcatcccacaggtctccatccggctggatggtgaaaacaaggcagtcgagtacaacgctgtgggtgccatgaaagatgctgtcagggtggtcttccgaggttctcgggtcaatgacctctttgaccgggactggcacaagatggccctgagcatccaggcccagaacgtctccctgcacattgactgtgcgctggtgcagacactacccatcgaggaacgggagaacattgacatccagggcaagactgtgattggcaagcgcctctacgacagtgtgcccattgactttgacctacagcggattgtgatctattgtgactcgagacacgcagaattggagacttgttgtgatatcccctcgggtccgtgccaggtgaccgtggtgacagagcctccacctccacccccaccccagcggcctcccaccccaggcagtgaacagattgggtttttgaagaccatcaactgctcctgcccagctggagagaagggtgaaatgggagttgctggccccatggggctccctggtccaaagggagacataggagccattgggccggttggcgctcctggacctaagggagagaaaggtgatgtgggcataggaccttttggccaaggggaaaagggtgaaaagggttccctgggcctgcccggcccccctgggagagacggcagcaaaggcatgagaggggagccaggagagctgggagagccggggctgccgggtgaggtcggcatgcgggggccccaaggaccacctggactccccggacctcctggacgtgtcggagctcctggtctccaaggagaacgaggtgaaaagggaactcgaggagaaaagggagagcgaggcctggatggattccctgggaagcctggggacacaggacagcagggcaggcccggcccttctggtgtggcaggaccccagggagaaaagggtgacgtgggacctgcggggccacctggtgtaccaggctcagtggtgcagcaagagggcttgaaaggggaacagggagctccaggacccagaggtcaccaaggcgcccccggtcctccaggagctcggggtccaataggcccagaaggcagggatggacctcctggtttgcaaggtctccgagggaagaaaggtgacatgggaccacctggaatccctggattgctggggctgcagggccctccaggaccccctggtgtcccaggcccccctggaccgggaggttctccgggtttgcctggagagatcggcttcccgggaaagcctggacctcctgggcccacgggaccccctggaaaggacgggccaaatggaccaccaggtccgccaggaaccaagggagaaccaggagaaagaggggaagatggtctgcctggaaaaccaggccttcggggagaaattggggagcagggcctggcaggccgacctggagagaagggagaagcaggcctcccaggggctccaggcttcccaggtgtgagaggagagaaaggagaccagggagaaaaaggtgaactgggacttccaggactgaaaggtgaccgaggtgaaaagggtgaagctggtcctgcaggccctcccgggttacctggaactacatccctgttcacaccacatccacggatgcccggagaacaagggcccaaaggagagaagggcgatccaggcctgcctggggaaccgggactgcagggccgtcctggagaattggggcctcagggacccactggaccaccgggtgccaagggacaggaaggtgcacatggggctcctggagcagctggaaaccccggtgctcccggacatgtcggtgcccccggtcccagtggccctccaggaagtgtgggtgctcccggcctcagaggcaccccagggaaagatggggagcgtggtgagaagggtgcagcgggggaagaaggcagcccagggccagttggtcccaggggagatcctggtgctcctgggctccctgggccacccggaaaagggaaggatggagagccgggactccgtggatcacctggactccctggacccctaggaaccaaggctgcttgcggaaaagtcagagggtcagaaaactgtgcactgggagggcaatgtgttaagggggatcgaggagctcctgggatccctggttctcctggcagccgtggtgacccaggcattggggttgctggccctcctggcccttccggaccaccaggagacaaaggatccccgggatcacgaggcttacctggattccctggcccccagggcccagccggccgggacggtgcaccaggaaatccaggagaaagagggcctcctggcaagccgggcctctcttcactactgtctccaggggacataaatctcttggctaaggatgtgtgcaatgactgccctcctggccccccaggcctccctggtctaccaggttttaaaggggacaaaggtgtcccaggaaagccagggagagaaggcacagaagggaaaaagggagaggctgggcctccaggcctaccagggcccccaggaatagctggaccacagggaagtcaaggagaacgtggtgcagatggtgaggttgggcagaaaggtgatcagggtcatcctggagttccaggtttcatggggcccccagggaaccctgggccaccaggggcagatggaattgcaggagctgctggaccaccaggaatccaagggtcacctgggaaagaaggccctcctggcccccaaggcccatctggattacccggaatcccaggagaagaaggcaaagagggcagagatggaaagccgggtccccctggagagccgggcaaagcaggagagccaggtctaccaggaccagagggtgcccgaggcccacctggcttcaagggacacacaggcgattctggtgcacccggtccccggggagagtctggtgccatggggcttcctggtcaggaagggttaccaggaaaagatggtgacactggacccactgggccacagggtccccaaggaccaaggggcccaccggtgagttgctgcactgctcccaggactcagttttctcatctgtaaaatggaggcaatctggacggaacaaggaggctgtaagaatccagcaaggtaatccagtgaagtgagacaacagtgcccagcccttggaatgtgccc

SEQ ID NO: 4715 - DNA, 4059 bp, synthetic construct
  misc_feature 1..4059: note = Synthetic polypeptide
  source 1..4059: mol_type = other DNA
atggccggcctccgagggaacgctgtggctggcctcctctggatgctgctgctgtggagtgggggcggcggctgccaggctcagcgggcaggttgcaaaagtgtccactacgatctggtcttcctcctggacacctcctccagcgtgggcaaggaggactttgagaaggtccggcagtgggtggccaacctggtggacaccttcgaggtgggccccgaccgcacccgtgtgggggtcgtgcgctacagcgaccggcccaccacggccttcgagttgggactctttggctcgcaggaggaggtcaaggcggctgcccggcgtctcgcctaccacgggggcaacaccaacacgggagacgcgctccgctacatcacggcccgcagcttctccccacacgccggcggccgccccagggaccgcgcctacaagcaggtggccatcctgctcaccgacggccgcagccaggacctggtgctggacgccgcggcggcagcccaccgcgctggcatccgcatctttgccgtgggcgtgggcgaggcactcaaggaggagctggaggagatcgcctcagagcccaagtccgcccacgtcttccacgtgtccgacttcaatgccatcgacaagatccggggcaagctgcggcgccgtctttgtgaaaatgtgctctgtcctagcgttcgtgtagaaggagatcgctttaagcacaccaatggaggaaccaaggaaatcacaggttttgacctgatggatttgttcagtgtgaaggaaatcttggggaagagagagaatggagctcagagttcctatgtacggatgggatccttccctgtggtgcaaagtactgaggatgtgttcccccaaggtttacctgatgagtacgcctttgtcacaaccttccggttcaggaaaacctctcggaaggaagactggtatatctggcaggtcatcgaccagtacagcatcccacaggtctccatccggctggatggtgaaaacaaggcagtcgagtacaacgctgtgggtgccatgaaagatgctgtcagggtggtcttccgaggttctcgggtcaatgacctctttgaccgggactggcacaagatggccctgagcatccaggcccagaacgtctccctgcacattgactgtgcgctggtgcagacactacccatcgaggaacgggagaacattgacatccagggcaagactgtgattggcaagcgcctctacgacagtgtgcccattgactttgacctacagcggattgtgatctattgtgactcgagacacgcagaattggagacttgttgtgatatcccctcgggtccgtgccaggtgaccgtggtgacagagcctccacctccacccccaccccagcggcctcccaccccaggcagtgaacagattgggtttttgaagaccatcaactgctcctgcccagctggagagaagggtgaaatgggagttgctggccccatggggctccctggtccaaagggagacataggagccattgggccggttggcgctcctggacctaagggagagaaaggtgatgtgggcataggaccttttggccaaggggaaaagggtgaaaagggttccctgggcctgcccggcccccctgggagagacggcagcaaaggcatgagaggggagccaggagagctgggagagccggggctgccgggtgaggtcggcatgcgggggccccaaggaccacctggactccccggacctcctggacgtgtcggagctcctggtctccaaggagaacgaggtgaaaagggaactcgaggagaaaagggagagcgaggcctggatggattccctgggaagcctggggacacaggacagcagggcaggcccggcccttctggtgtggcaggaccccagggagaaaagggtgacgtgggacctgcggggccacctggtgtaccaggctcagtggtgcagcaagagggcttgaaaggggaacagggagctccaggacccagaggtcaccaaggcgcccccggtcctccaggagctcggggtccaataggcccagaaggcagggatggacctcctggtttgcaaggtctccgagggaagaaaggtgacatgggaccacctggaatccctggattgctggggctgcagggccctccaggaccccctggtgtcccaggcccccctggaccgggaggttctccgggtttgcctggagagatcggcttcccgggaaagcctggacctcctgggcccacgggaccccctggaaaggacgggccaaatggaccaccaggtccgccaggaaccaagggagaaccaggagaaagaggggaagatggtctgcctggaaaaccaggccttcggggagaaattggggagcagggcctggcaggccgacctggagagaagggagaagcaggcctcccaggggctccaggcttcccaggtgtgagaggagagaaaggagaccagggagaaaaaggtgaactgggacttccaggactgaaaggtgaccgaggtgaaaagggtgaagctggtcctgcaggccctcccgggttacctggaactacatccctgttcacaccacatccacggatgcccggagaacaagggcccaaaggagagaagggcgatccaggcctgcctggggaaccgggactgcagggccgtcctggagaattggggcctcagggacccactggaccaccgggtgccaagggacaggaaggtgcacatggggctcctggagcagctggaaaccccggtgctcccggacatgtcggtgcccccggtcccagtggccctccaggaagtgtgggtgctcccggcctcagaggcaccccagggaaagatggggagcgtggtgagaagggtgcagcgggggaagaaggcagcccagggccagttggtcccaggggagatcctggtgctcctgggctccctgggccacccggaaaagggaaggatggagagccgggactccgtggatcacctggactccctggacccctaggaaccaagggggatcgaggagctcctgggatccctggttctcctggcagccgtggtgacccaggcattggggttgctggccctcctggcccttccggaccaccaggagacaaaggatccccgggatcacgaggcttacctggattccctggcccccagggcccagccggccgggacggtgcaccaggaaatccaggagaaagagggcctcctggcaagccgggcctctcttcactactgtctccaggggacataaatctcttggctaaggatgtgtgcaatgactgccctcctggccccccaggcctccctggtctaccaggttttaaaggggacaaaggtgtcccaggaaagccagggagagaaggcacagaagggaaaaagggagaggctgggcctccaggcctaccagggcccccaggaatagctggaccacagggaagtcaaggagaacgtggtgcagatggtgaggttgggcagaaaggtgatcagggtcatcctggagttccaggtttcatggggcccccagggaaccctgggccaccaggggcagatggaattgcaggagctgctggaccaccaggaatccaagggtcacctgggaaagaaggccctcctggcccccaaggcccatctggattacccggaatcccaggagaagaaggcaaagagggcagagatggaaagccgggtccccctggagagccgggcaaagcaggagagccaggtctaccaggaccagagggtgcccgaggcccacctggcttcaagggacacacaggcgattctggtgcacccggtccccggggagagtctggtgccatggggcttcctggtcaggaagggttaccaggaaaagatggtgacactggacccactgggccacagggtccccaaggaccaaggggcccaccggtgagttgctgcactgctcccaggactcagttttctcatctgtaaaatggaggcaatctggacggaacaaggaggctgtaagaatccagcaaggtaatccagtgaagtgagacaacagtgcccagcccttggaatgtgccc

SEQ ID NO: 4716 - DNA, 818 bp, synthetic construct
  misc_feature 1..818: note = Synthetic polypeptide
  source 1..818: mol_type = other DNA
atggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacagaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagagacggaggttgcagtgagccgagatcccaccactgcactccagcctcggtgacaagagcgaaactccgtctcaagaaaa

SEQ ID NO: 4717 - DNA, 602 bp, synthetic construct
  misc_feature 1..602: note = Synthetic polypeptide
  source 1..602: mol_type = other DNA
atggatgaggatgccctcagccgggacgacgttatcggaaaggtctgccttacaagggacaccatagcctctcaccctaagggtttcagcgggtgggcccacctgacagaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagagacggaggttgcagtgagccgagatcccaccactgcactccagcctcggtgacaagagcgaaactccgtctcaagaaaa

SEQ ID NO: 4718 - DNA, 818 bp, synthetic construct
  misc_feature 1..818: note = Synthetic polypeptide
  source 1..818: mol_type = other DNA
atggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgatgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagagacggaggttgcagtgagccgagatcccaccactgcactccagcctcggtgacaagagcgaaactccgtctcaagaaaa

SEQ ID NO: 4719 - DNA, 602 bp, synthetic construct
  misc_feature 1..602: note = Synthetic polypeptide
  source 1..602: mol_type = other DNA
atggatgaggatgccctcagccgggacgacgttatcggaaaggtctgccttacaagggacaccatagcctctcaccctaagggtttcagcgggtgggcccacctgacggaggtcgaccccgatgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagagacggaggttgcagtgagccgagatcccaccactgcactccagcctcggtgacaagagcgaaactccgtctcaagaaaa

SEQ ID NO: 4720 - DNA, 381 bp, synthetic construct
  misc_feature 1..381: note = Synthetic polypeptide
  source 1..381: mol_type = other DNA
cccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagagacggaggttgcagtgagccgagatcccaccactgcactccagcctcggtgacaagagcgaaactccgtctcaagaaaa

SEQ ID NO: 4721 - DNA, 761 bp, synthetic construct
  misc_feature 1..761: note = Synthetic polypeptide
  source 1..761: mol_type = other DNA
atggccaagcgcagctcgctgtacatccgcatcgtggaggggaagaaccttcccgccaaggacatgacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgatgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagagacggaggttgcagtgagccgagatcccaccactgcactccagcctcggtgacaagagcgaaactccgtctcaagaaaa

SEQ ID NO: 4722 - DNA, 802 bp, synthetic construct; identical to SEQ ID NO: 2212
  misc_feature 1..802: note = Synthetic polypeptide
  source 1..802: mol_type = other DNA

SEQ ID NO: 4723 - DNA, 2141 bp, synthetic construct; identical to SEQ ID NO: 2213
  misc_feature 1..2141: note = Synthetic polypeptide
  source 1..2141: mol_type = other DNA

SEQ ID NO: 4724 - DNA, 2192 bp, synthetic construct; identical to SEQ ID NO: 2214
  misc_feature 1..2192: note = Synthetic polypeptide
  source 1..2192: mol_type = other DNA

SEQ ID NO: 4725 - DNA, 2015 bp, synthetic construct; identical to SEQ ID NO: 2215
  misc_feature 1..2015: note = Synthetic polypeptide
  source 1..2015: mol_type = other DNA

SEQ ID NO: 4726 - DNA, 2466 bp, synthetic construct; identical to SEQ ID NO: 1682
  misc_feature 1..2466: note = Synthetic polypeptide
  source 1..2466: mol_type = other DNA

SEQ ID NO: 4727 - DNA, 1806 bp, synthetic construct; identical to SEQ ID NO: 1683
  misc_feature 1..1806: note = Synthetic polypeptide
  source 1..1806: mol_type = other DNA

SEQ ID NO: 4728 - DNA, 2412 bp, synthetic construct; identical to SEQ ID NO: 1684
  misc_feature 1..2412: note = Synthetic polypeptide
  source 1..2412: mol_type = other DNA

SEQ ID NO: 4729 - DNA, 2211 bp, synthetic construct; identical to SEQ ID NO: 1685
  misc_feature 1..2211: note = Synthetic polypeptide
  source 1..2211: mol_type = other DNA

SEQ ID NO: 4730 - DNA, 364 bp, synthetic construct; identical to SEQ ID NO: 1686
  misc_feature 1..364: note = Synthetic polypeptide
  source 1..364: mol_type = other DNA

SEQ ID NO: 4731 - DNA, 303 bp, synthetic construct; identical to SEQ ID NO: 148
  misc_feature 1..303: note = Synthetic polypeptide
  source 1..303: mol_type = other DNA

SEQ ID NO: 4732 - DNA, 301 bp, synthetic construct; identical to SEQ ID NO: 147
  misc_feature 1..301: note = Synthetic polypeptide
  source 1..301: mol_type = other DNA

SEQ ID NO: 4733 - DNA, 2161 bp, synthetic construct; identical to SEQ ID NO: 288
  misc_feature 1..2161: note = Synthetic polypeptide
  source 1..2161: mol_type = other DNA

SEQ ID NO: 4734 - DNA, 2140 bp, synthetic construct; identical to SEQ ID NO: 289
  misc_feature 1..2140: note = Synthetic polypeptide
  source 1..2140: mol_type = other DNA

SEQ ID NO: 4735 - DNA, 529 bp, synthetic construct; identical to SEQ ID NO: 287
  misc_feature 1..529: note = Synthetic polypeptide
  source 1..529: mol_type = other DNA

SEQ ID NO: 4736 - DNA, 628 bp, synthetic construct; identical to SEQ ID NO: 3115
  misc_feature 1..628: note = Synthetic polypeptide
  source 1..628: mol_type = other DNA

SEQ ID NO: 4737 - DNA, 412 bp, synthetic construct; identical to SEQ ID NO: 3116
  misc_feature 1..412: note = Synthetic polypeptide
  source 1..412: mol_type = other DNA

SEQ ID NO: 4738 - DNA, 582 bp, synthetic construct
  misc_feature 1..582: note = Synthetic polypeptide
  source 1..582: mol_type = other DNA
atggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccagcctgggcgacaagagcgaaactccatctccgaaaaaagaaa

SEQ ID NO: 4739 - DNA, 546 bp, synthetic construct
  misc_feature 1..546: note = Synthetic polypeptide
  source 1..546: mol_type = other DNA
atggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccagcctgggcgacaagagcgaaactccatctccgaaaaaagaaa

SEQ ID NO: 4740 - DNA, 567 bp, synthetic construct
  misc_feature 1..567: note = Synthetic polypeptide
  source 1..567: mol_type = other DNA
atggcgggtctgacggcggcggccccgcggcccggagtcctcctgctcctgctgtccatcctccacccctctcggcctggaggggtccctggggccattcctggtggagttcctggaggagtcttttatccagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcagccccttctgtgccaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccagcctgggcgacaagagcgaaactccatctccgaaaaaagaaa

SEQ ID NO: 4741 - DNA, 552 bp, synthetic construct
  misc_feature 1..552: note = Synthetic polypeptide
  source 1..552: mol_type = other DNA
atggcgggtctgacggcggcggccccgcggcccggagtcctcctgctcctgctgtccatcctccacccctctcggcctggaggggtccctggggccattcctggtggagttcctggaggagtcttttatccagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccagcctgggcgacaagagcgaaactccatctccgaaaaaagaaa

SEQ ID NO: 4742 - DNA, 597 bp, synthetic construct
  misc_feature 1..597: note = Synthetic polypeptide
  source 1..597: mol_type = other DNA
atggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcagccccttctgtgccaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccagcctgggcgacaagagcgaaactccatctccgaaaaaagaaa

SEQ ID NO: 4743 - DNA, 645 bp, synthetic construct
  misc_feature 1..645: note = Synthetic polypeptide
  source 1..645: mol_type = other DNA
atgcgctccgccgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaagaggcggtggaagagccatcatccaaggatgttatggagaaaagagaggattccaaggaggcagagaaaagtggtaacgccacagagacagcaacgagctcagcggctgccaataacatgaggtgggggaaatggggagtgagtgccggtgggcccagggttttcttctcagtgatgaaaatgttttggaaccagatagaggtggtgattggacaacactgtgaaggtactaattgccactgaattattcgctttaaaatggttaatcttatgtatgtgaatttacctcaa

SEQ ID NO: 4744 - DNA, 861 bp, synthetic construct
  misc_feature 1..861: note = Synthetic polypeptide
  source 1..861: mol_type = other DNA
atggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgatgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagccgggtatggtggcgcatgcctgtaatctcagcactttgggaggccaaggcaggaggatcacttgagcccaggagttcaagaccagcctgggcaacatagcaagaccccatctctaaaaaaaa

SEQ ID NO: 4745 - DNA, 645 bp, synthetic construct
  misc_feature 1..645: note = Synthetic polypeptide
  source 1..645: mol_type = other DNA
atggatgaggatgccctcagccgggacgacgttatcggaaaggtctgccttacaagggacaccatagcctctcaccctaagggtttcagcgggtgggcccacctgacggaggtcgaccccgatgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagccgggtatggtggcgcatgcctgtaatctcagcactttgggaggccaaggcaggaggatcacttgagcccaggagttcaagaccagcctgggcaacatagcaagaccccatctctaaaaaaaa

SEQ ID NO: 4746 - DNA, 424 bp, synthetic construct
  misc_feature 1..424: note = Synthetic polypeptide
  source 1..424: mol_type = other DNA
cccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagccgggtatggtggcgcatgcctgtaatctcagcactttgggaggccaaggcaggaggatcacttgagcccaggagttcaagaccagcctgggcaacatagcaagaccccatctctaaaaaaaa

SEQ ID NO: 4747 - DNA, 804 bp, synthetic construct
  misc_feature 1..804: note = Synthetic polypeptide
  source 1..804: mol_type = other DNA
atggccaagcgcagctcgctgtacatccgcatcgtggaggggaagaaccttcccgccaaggacatgacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgatgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagccgggtatggtggcgcatgcctgtaatctcagcactttgggaggccaaggcaggaggatcacttgagcccaggagttcaagaccagcctgggcaacatagcaagaccccatctctaaaaaaaa

SEQ ID NO: 4748 - DNA, 3161 bp, synthetic construct
  misc_feature 1..3161: note = Synthetic polypeptide
  source 1..3161: mol_type = other DNA
atgggggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggccaagcgcggtggctcccgcctgtaatcccagcactttgggaggcccaggcgggcgggtcacttgaggtcaggagtacgagaccagcctggccaacatggcgaaaccccatctctacgaaaaatacaaaaaaaaaaaaaaaaaaaaa

SEQ ID NO: 4749 - DNA, 3200 bp, synthetic construct
  misc_feature 1..3200: note = Synthetic polypeptide
  source 1..3200: mol_type = other DNA
atggggtctggtggctctgacagctatcgtatcgccacctcgcaggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggccaagcgcggtggctcccgcctgtaatcccagcactttgggaggcccaggcgggcgggtcacttgaggtcaggagtacgagaccagcctggccaacatggcgaaaccccatctctacgaaaaatacaaaaaaaaaaaaaaaaaaaaa

SEQ ID NO: 4750 - DNA, 3194 bp, synthetic construct
  misc_feature 1..3194: note = Synthetic polypeptide
  source 1..3194: mol_type = other DNA
atgggaggctgggaggaggagaggaacaggagagccacggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggccaagcgcggtggctcccgcctgtaatcccagcactttgggaggcccaggcgggcgggtcacttgaggtcaggagtacgagaccagcctggccaacatggcgaaaccccatctctacgaaaaatacaaaaaaaaaaaaaaaaaaaaa

SEQ ID NO: 4751 - DNA, 3071 bp, synthetic construct
  misc_feature 1..3071: note = Synthetic polypeptide
  source 1..3071: mol_type = other DNA
atgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggccaagcgcggtggctcccgcctgtaatcccagcactttgggaggcccaggcgggcgggtcacttgaggtcaggagtacgagaccagcctggccaacatggcgaaaccccatctctacgaaaaatacaaaaaaaaaaaaaaaaaaaaa

SEQ ID NO: 4752 - DNA, 861 bp, synthetic construct
  misc_feature 1..861: note = Synthetic polypeptide
  source 1..861: mol_type = other DNA
atggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacagaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagccgggtatggtggcgcatgcctgtaatctcagcactttgggaggccaaggcaggaggatcacttgagcccaggagttcaagaccagcctgggcaacatagcaagaccccatctctaaaaaaaa

SEQ ID NO: 4753 - DNA, 645 bp, synthetic construct
  misc_feature 1..645: note = Synthetic polypeptide
  source 1..645: mol_type = other DNA
atggatgaggatgccctcagccgggacgacgttatcggaaaggtctgccttacaagggacaccatagcctctcaccctaagggtttcagcgggtgggcccacctgacagaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagccgggtatggtggcgcatgcctgtaatctcagcactttgggaggccaaggcaggaggatcacttgagcccaggagttcaagaccagcctgggcaacatagcaagaccccatctctaaaaaaaa

SEQ ID NO: 4754 - DNA, 1065 bp, synthetic construct; identical to SEQ ID NO: 4373
  misc_feature 1..1065: note = Synthetic polypeptide
  source 1..1065: mol_type = other DNA

SEQ ID NO: 4755 - DNA, 128 bp, synthetic construct; identical to SEQ ID NO: 1082
  misc_feature 1..128: note = Synthetic polypeptide
  source 1..128: mol_type = other DNA

SEQ ID NO: 4756 - DNA, 546 bp, synthetic construct
  misc_feature 1..546: note = Synthetic polypeptide
  source 1..546: mol_type = other DNA
atgcagaaaagacaaggatattgcagttattgccgtgtgcagtataataacctggaacagactctcactaaaggaaaaactaaaaaggagttcttcaggcagaaggaaaatgattcccgatggaagctcagagatacaggaagtaatgaagaacagtggaaaggtaaatatgtaggcaatcaatctaagtgaatactgtcttgtgggatgaacaacaatggcatataaattgggaggggagtaaatgatgttaatttctaaggactttgcattgtttataaagagaataaaagtaacaagtaattttaggcgttgacagttcagggttgctcattgtaatctcttaccaaaatagactatgaaaagtctgtaactaactacagagttaacagaaaaggaaaaattgaaatgatgaaacgtagtccacaagaagacaagaaaggagaggaaaagggatagttgtataggcaagagtaacagattgaaaaagttaaatacaactctatcagtaatacattaagtgaaaataggtttgatgcttgaatt

SEQ ID NO: 4757 - DNA, 3840 bp, synthetic construct
  misc_feature 1..3840: note = Synthetic polypeptide
  source 1..3840: mol_type = other DNA
atggggttcctgaaactgattgagattgagaactttaagtcgtacaagggtcgacagattatcggaccatttcagaggttcaccgccatcattggacccaatggctctggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggaggttcttctgagtacaagatcaacaacaaagtggtccaactacatgagtacagtgaggaattagagaagttgggcattctcatcaaagctcgtaacttcctcgttttccagggtgctgtggaatctattgccatgaagaaccccaaagagaggacagctctatttgaagagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaagaggctgaccggtaccagcgcctgaaggatgaggtagtacgggctcaggtacagctgcagctctttaagctttaccataatgaagtggaaattgagaagctcaacaaggaactggcctcaaagaacaaggagatcgagaaggacaagaagcgtatggacaaggtggaggatgaactgaaggagaagaagaaggagctgggcaaaatgatgcgggagcagcagcagattgagaaggagatcaaggagaaggactcagaattgaaccagaagcggcctcagtacatcaaagccaaggagaacacctcccacaaaatcaagaagctggaagcagccaagaagtctctgcagaatgctcagaagcactacaagaagcgtaaaggtgacatggatgagctggagaaggagatgctgtcagtggagaaggctcggcaggagtttgaagaacggatggaagaagagagtcagagtcagggcagagatttgacgttggaggagaatcaggtgaagaaataccaccggttgaaagaagaagccagcaagagagcagctaccctggcccaggagctggagaaattcaatcgagaccagaaagctgaccaggaccgtctggatctggaagaacggaagaaagtagagacagaggccaagatcaagcaaaagctgcgggaaattgaagagaatcagaagcggattgagaaactggaggaatacatcaccactagcaagcagtccctagaagagcagaagaagctagagggggagctgacagaggaggtggagatggccaagcggcgtattgatgaaatcaataaggagctgaaccaggtgatggagcagctaggggatgcccgcatcgaccgccaggagagcagccgccagcagcgaaaggcagagataatggaaagcatcaagcgcctttaccctggctctgtgtacggccgcctcattgacctatgccagcccacacaaaagaagtatcagattgctgtaaccaaggttttgggcaagaacatggatgccattattgtggactcggagaagacaggccgggactgtattcagtatatcaaggagcagcgtggggagcctgagaccttcttgcctcttgactacctggaggtgaagcctacagatgagaaactccgggagctgaagggggccaagctagtgattgatgtgattcgctatgagccacctcatatcaaaaaggccctgcagtatgcttgtggcaatgcccttgtctgtgacaacgtggaagatgcccgccgcattgcctttggaggccaccagcgccacaagacagtggcactggatggaaccctattccagaagtcaggagtgatctctggtggggccagtgacctgaaggccaaggcacggcgctgggatgagaaagcagtagacaagttgaaagagaagaaggagcgcttgacagaggagctgaaagagcagatgaaggcaaaacggaaagaggcagagctgcgtcaggtgcagtctcaggcccatggactgcagatgcggctcaagtactcccagagtgacctagaacagaccaagacacgacatctagccctgaatctgcaggaaaaatccaagctggagagtgagctagccaactttgggcctcgcattaatgatatcaagaggatcattcagagccgagagagggaaatgaaagacttgaaggagaagatgaaccaggtagaggatgaggtgtttgaagagttttgtcgggagattggtgtgcgcaacatccgggagtttgaggaagaaaaggtgaaacggcagaatgaaatcgccaagaagcgtttggagtttgagaatcagaagactcgcttgggcattcagttggattttgaaaagaaccaactgaaggaggaccaagataaagtacacatgtgggagcagacagtgaaaaaagatgaaaatgagatagaaaagctcaaaaaggaggaacaaagacacatgaagatcatagatgagaccatggctcagctacaagacctgaagaatcagcatctggccaagaagtcggaagtgaatgacaagaatcatgagatggaggagattcgtaagaaactcgggggcgccaacaaggaaatgacccatttacagaaggaggtgacagccattgagaccaagcttgaacagaagcgcagtgaccgtcacaacttgctacaggcctgtaagatgcaggacattaagttgccactgtcaaaaggcaccatggatgatattagtcaggaagagggtagctcccagggggaggactcagtgagtggttcacagagaatttccagtatctatgcacgagaggccctcattgagattgactacggtgatctgtgtgaggatctgaaggatgcccaggctgaggaagagatcaagcaagagatgaacacactgcagcagaagctgaatgagcagcagagtgtgcttcagcgtattgccgcccccaacatgaaggccatggaaaagctggaaagtgtccgagacaagttccaggagacctcagatgagtttgaagcagcccgaaagcgagcaaagaaggccaagcaggcattcgaacagatcaagaaggagcgctttgaccgcttcaatgcttgttttgaatctgtggctaccaacattgatgagatctataaggccctgtcccgcaatagcagtgcccaggcattcctgggccctgagaaccctgaagagccctacttggatggcatcaactacaactgtgtggctcctgggaaacgcttccggcctatggacaacttgtcaggcggggagaagacagtggcagctctggccctgctctttgccatccacagctacaagccagcccccttcttcgtcctggatgagattgatgctgccttggataacaccaacattggcaaggtggcaaattacatcaaggagcagtcgacttgcaacttccaggccatcgtcatctctctcaaggaggagttctacaccaaggccgagagcctcattggagtctatcctgagtcaagccgtctggagctgtgacagccatcttgtgaccatgtggggatgagcacgaggaagaagacaacatgtgaaggaagaaagtcagaaagagcccaatttcttgatggcatcattgagcagctgaacccatgccacagttcctgttaacttaaaaaaataaataaagccatatgtgtttaagccactatcagttgagttttttgttacttgtagctgaaa

SEQ ID NO: 4758 - DNA, 1060 bp, synthetic construct
  misc_feature 1..1060: note = Synthetic polypeptide
  source 1..1060: mol_type = other DNA
aaatgacccatttacagaaggaggtgacagccattgagaccaagcttgaacagaagcgcagtgaccgtcacaacttgctacaggcctgtaagatgcaggacattaagttgccactgtcaaaaggcaccatggatgatattagtcaggaagagggtagctcccagggggaggactcagtgagtggttcacagagaatttccagtatctatgcacgagaggccctcattgagattgactacggtgatctgtgtgaggatctgaaggatgcccaggctgaggaagagatcaagcaagagatgaacacactgcagcagaagctgaatgagcagcagagtgtgcttcagcgtattgccgcccccaacatgaaggccatggaaaagctggaaagtgtccgagacaagttccaggagacctcagatgagtttgaagcagcccgaaagcgagcaaagaaggccaagcaggcattcgaacagatcaagaaggagcgctttgaccgcttcaatgcttgttttgaatctgtggctaccaacattgatgagatctataaggccctgtcccgcaatagcagtgcccaggcattcctgggccctgagaaccctgaagagccctacttggatggcatcaactacaactgtgtggctcctgggaaacgcttccggcctatggacaacttgtcaggcggggagaagacagtggcagctctggccctgctctttgccatccacaggtggcaaattacatcaaggagcagtcgacttgcaacttccaggccatcgtcatctctctcaaggaggagttctacaccaaggccgagagcctcattggagtctatcctgagtcaagccgtctggagctgtgacagccatcttgtgaccatgtggggatgagcacgaggaagaagacaacatgtgaaggaagaaagtcagaaagagcccaatttcttgatggcatcattgagcagctgaacccatgccacagttcctgttaacttaaaaaaataaataaagccatatgtgtttaagccactatcagttgagttttttgttacttgtagctgaaa

SEQ ID NO: 4759 - DNA, 565 bp, synthetic construct; identical to SEQ ID NO: 1420
  misc_feature 1..565: note = Synthetic polypeptide
  source 1..565: mol_type = other DNA

SEQ ID NO: 4760 - DNA, 718 bp, synthetic construct; identical to SEQ ID NO: 1366
  misc_feature 1..718: note = Synthetic polypeptide
  source 1..718: mol_type = other DNA

SEQ ID NO: 4761 - DNA, 353 bp, synthetic construct; identical to SEQ ID NO: 2268
  misc_feature 1..353: note = Synthetic polypeptide
  source 1..353: mol_type = other DNA

SEQ ID NO: 4762 - DNA, 340 bp, synthetic construct; identical to SEQ ID NO: 2269
  misc_feature 1..340: note = Synthetic polypeptide
  source 1..340: mol_type = other DNA

SEQ ID NO: 4763 - DNA, 362 bp, synthetic construct; identical to SEQ ID NO: 2270
  misc_feature 1..362: note = Synthetic polypeptide
  source 1..362: mol_type = other DNA

SEQ ID NO: 4764 - DNA, 2532 bp, synthetic construct
  misc_feature 1..2532: note = Synthetic polypeptide
  source 1..2532: mol_type = other DNA
atgggggcccggagcggagctcggggcgcgctgctgctggcactgctgctctgctgggacccgaggctgagccaagcaggcactgattctggcagcgaggtgctccctgactccttcccgtcagcgccagcagagccgctgccctacttcctgcaggagccacaggacgcctacattgtgaagaacaagcctgtggagctccgctgccgcgccttccccgccacacagatctacttcaagtgcaacggcgagtgggtcagccagaacgaccacgtcacacaggaaggcctggatgaggccaccggcctgcgggtgcgcgaggtgcagatcgaggtgtcgcggcagcaggtggaggagctctttgggctggaggattactggtgccagtgcgtggcctggagctccgcgggcaccaccaagagtcgccgagcctacgtccgcatcgcctacctgcgcaagaacttcgatcaggagcctctgggcaaggaggtgcccctggaccatgaggttctcctgcagtgccgcccgccggagggggtgcctgtggccgaggtggaatggctcaagaatgaggatgtcatcgaccccacccaggacaccaacttcctgctcaccatcgaccacaacctcatcatccgccaggcccgcctgtcggacactgccaactatacctgcgtggccaagaacatcgtggccaaacgccggagcaccactgccaccgtcatcgtctacgtgaatggcggctggtccagctgggcagagtggtcaccctgctccaaccgctgtggccgaggctggcagaagcgcacccggacctgcaccaaccccgctccactcaacggaggggccttctgcgagggccaggcattccagaagaccgcctgcaccaccatctgcccagtcgatggggcgtggacggagtggagcaagtggtcagcctgcagcactgagtgtgcccactggcgtagccgcgagtgcatggcgcccccaccccagaacggaggccgtgactgcagcgggacgctgctcgactctaagaactgcacagatgggctgtgcatgcaaaataagaaaactctaagcgaccccaacagccacctgctggaggcctcaggggatgcggcgctgtatgcggggctcgtggtggccatcttcgtggtcgtggcaatcctcatggcggtgggggtggtggtgtaccgccgcaactgccgtgacttcgacacagacatcactgactcatctgctgccctgactggtggtttccaccccgtcaactttaagacggcaaggcccagcaacccgcagctcctacacccctctgtgcctcctgacctgacagccagcgccggcatctaccgcggacccgtgtatgccctgcaggactccaccgacaaaatccccatgaccaactctcctctgctggaccccttacccagccttaaggtcaaggtctacagctccagcaccacgggctctgggccaggcctggcagatggggctgacctgctgggggtcttgccgcctggcacataccctagcgatttcgcccgggacacccacttcctgcacctgcgcagcgccagcctcggttcccagcagctcttgggcctgccccgagacccagggagcagcgtcagcggcacctttggctgcctgggtgggaggctcagcatccccggcacaggggtcagcttgctggtgcccaatggagccattccccagggcaagttctacgagatgtatctactcatcaacaaggcagaaagtaccctcccgctttcagaagggacccagacagtattgagcccctcggtgacctgtggacccacaggcctcctgctgtgccgccccgtcatcctcaccatgccccactgtgccgaagtcagtgcccgtgactggatctttcagctcaagacccaggcccaccagggccactgggaggaggtggtgaccctggatgaggagaccctgaacacaccctgctactgccagctggagcccagggcctgtcacatcctgctggaccagctgggcacctacgtgttcacgggcgagtcctattcccgctcagcagtcaagcggctccagctggccgtcttcgcccccgccctctgcacctccctggagtacagcctccgggtctactgcctggaggacacgcctgtagcactgaaggaggtgctggagctggagcggactctgggcggatacttggtggaggagccgaaaccgctaatgttcaaggacagttaccacaacctgcgcctctccctccatgacctcccccatgcccattggaggagcaagctgctggccaaataccaggagatccccttctatcacatttggagtggcagccagaaggccctccactgcactttcaccctggagaggcacagcttggcctccacagagctcacctgcaagatctgcgtgcggcaagtggaaggggagggccagatattccagctgcataccactctggcagagacttcactttccacctgtacaagagggtgcatgtggattaga

SEQ ID NO: 4765 - DNA, 2499 bp, synthetic construct
  misc_feature 1..2499: note = Synthetic polypeptide
  source 1..2499: mol_type = other DNA
atgggggcccggagcggagctcggggcgcgctgctgctggcactgctgctctgctgggacccgaggctgagccaagcaggcactgattctggcagcgaggtgctccctgactccttcccgtcagcgccagcagagccgctgccctacttcctgcaggagccacaggacgcctacattgtgaagaacaagcctgtggagctccgctgccgcgccttccccgccacacagatctacttcaagtgcaacggcgagtgggtcagccagaacgaccacgtcacacaggaaggcctggatgaggccaccggcctgcgggtgcgcgaggtgcagatcgaggtgtcgcggcagcaggtggaggagctctttgggctggaggattactggtgccagtgcgtggcctggagctccgcgggcaccaccaagagtcgccgagcctacgtccgcatcgcctacctgcgcaagaacttcgatcaggagcctctgggcaaggaggtgcccctggaccatgaggttctcctgcagtgccgcccgccggagggggtgcctgtggccgaggtggaatggctcaagaatgaggatgtcatcgaccccacccaggacaccaacttcctgctcaccatcgaccacaacctcatcatccgccaggcccgcctgtcggacactgccaactatacctgcgtggccaagaacatcgtggccaaacgccggagcaccactgccaccgtcatcgtctacgtgaatggcggctggtccagctgggcagagtggtcaccctgctccaaccgctgtggccgaggctggcagaagcgcacccggacctgcaccaaccccgctccactcaacggaggggccttctgcgagggccaggcattccagaagaccgcctgcaccaccatctgcccagtcgatggggcgtggacggagtggagcaagtggtcagcctgcagcactgagtgtgcccactggcgtagccgcgagtgcatggcgcccccaccccagaacggaggccgtgactgcagcgggacgctgctcgactctaagaactgcacagatgggctgtgcatgcaaatgctggaggcctcaggggatgcggcgctgtatgcggggctcgtggtggccatcttcgtggtcgtggcaatcctcatggcggtgggggtggtggtgtaccgccgcaactgccgtgacttcgacacagacatcactgactcatctgctgccctgactggtggtttccaccccgtcaactttaagacggcaaggcccagcaacccgcagctcctacacccctctgtgcctcctgacctgacagccagcgccggcatctaccgcggacccgtgtatgccctgcaggactccaccgacaaaatccccatgaccaactctcctctgctggaccccttacccagccttaaggtcaaggtctacagctccagcaccacgggctctgggccaggcctggcagatggggctgacctgctgggggtcttgccgcctggcacataccctagcgatttcgcccgggacacccacttcctgcacctgcgcagcgccagcctcggttcccagcagctcttgggcctgccccgagacccagggagcagcgtcagcggcacctttggctgcctgggtgggaggctcagcatccccggcacaggggtcagcttgctggtgcccaatggagccattccccagggcaagttctacgagatgtatctactcatcaacaaggcagaaagtaccctcccgctttcagaagggacccagacagtattgagcccctcggtgacctgtggacccacaggcctcctgctgtgccgccccgtcatcctcaccatgccccactgtgccgaagtcagtgcccgtgactggatctttcagctcaagacccaggcccaccagggccactgggaggaggtggtgaccctggatgaggagaccctgaacacaccctgctactgccagctggagcccagggcctgtcacatcctgctggaccagctgggcacctacgtgttcacgggcgagtcctattcccgctcagcagtcaagcggctccagctggccgtcttcgcccccgccctctgcacctccctggagtacagcctccgggtctactgcctggaggacacgcctgtagcactgaaggaggtgctggagctggagcggactctgggcggatacttggtggaggagccgaaaccgctaatgttcaaggacagttaccacaacctgcgcctctccctccatgacctcccccatgcccattggaggagcaagctgctggccaaataccaggagatccccttctatcacatttggagtggcagccagaaggccctccactgcactttcaccctggagaggcacagcttggcctccacagagctcacctgcaagatctgcgtgcggcaagtggaaggggagggccagatattccagctgcataccactctggcagagacttcactttccacctgtacaagagggtgcatgtggattaga

SEQ ID NO: 4766 - DNA, 1061 bp, synthetic construct
  misc_feature 1..1061: note = Synthetic polypeptide
  source 1..1061: mol_type = other DNA
atggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagcagatgatggatgtctagaaaacacccctgacactgcagagttcagtcgagagttccagttgcaccagcatctctttgatccggaacatgactatccaggcttgggcaagtggaaagagaaaaaatattccgtgatgtgtagcagtgagattgctgtcagtcctaggtaagtgcatatagctgtcagttaagggagttgtttataagcacttggaaagataaatcatgaccatttggcatcagtgtgctaaaaacaagtcttgccaatctaattatattcttccatttgccagcattattcatttatttgccagcttgatgagggaaatgcagtgggcatggtgcatttggacttttgcaaagcatttgacaagatcgttttatgttcccctattggaagaggtggaaagatacagcctaggcaacagaatgtcaccaaaatggggcttgttaaagagtccatgtaaatagggagggagatttcacatggtattctgtgtgtcttagcactaccccactccacatttttatcaatgtttgtaataatatagaacttgtacttatcagattcccagaggatgacatgaagttggaagagataccatcagatgacagagttgggattcaagaagatcccagcagactagaacaatgagccaaacaagatcagaactgagtggggata

SEQ ID NO: 4767 - DNA, 1058 bp, synthetic construct
  misc_feature 1..1058: note = Synthetic polypeptide
  source 1..1058: mol_type = other DNA
atggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagatgatggatgtctagaaaacacccctgacactgcagagttcagtcgagagttccagttgcaccagcatctctttgatccggaacatgactatccaggcttgggcaagtggaaagagaaaaaatattccgtgatgtgtagcagtgagattgctgtcagtcctaggtaagtgcatatagctgtcagttaagggagttgtttataagcacttggaaagataaatcatgaccatttggcatcagtgtgctaaaaacaagtcttgccaatctaattatattcttccatttgccagcattattcatttatttgccagcttgatgagggaaatgcagtgggcatggtgcatttggacttttgcaaagcatttgacaagatcgttttatgttcccctattggaagaggtggaaagatacagcctaggcaacagaatgtcaccaaaatggggcttgttaaagagtccatgtaaatagggagggagatttcacatggtattctgtgtgtcttagcactaccccactccacatttttatcaatgtttgtaataatatagaacttgtacttatcagattcccagaggatgacatgaagttggaagagataccatcagatgacagagttgggattcaagaagatcccagcagactagaacaatgagccaaacaagatcagaactgagtggggata

SEQ ID NO: 4768 - DNA, 1031 bp, synthetic construct
  misc_feature 1..1031: note = Synthetic polypeptide
  source 1..1031: mol_type = other DNA
tctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagcagatgatggatgtctagaaaacacccctgacactgcagagttcagtcgagagttccagttgcaccagcatctctttgatccggaacatgactatccaggcttgggcaagtggaaagagaaaaaatattccgtgatgtgtagcagtgagattgctgtcagtcctaggtaagtgcatatagctgtcagttaagggagttgtttataagcacttggaaagataaatcatgaccatttggcatcagtgtgctaaaaacaagtcttgccaatctaattatattcttccatttgccagcattattcatttatttgccagcttgatgagggaaatgcagtgggcatggtgcatttggacttttgcaaagcatttgacaagatcgttttatgttcccctattggaagaggtggaaagatacagcctaggcaacagaatgtcaccaaaatggggcttgttaaagagtccatgtaaatagggagggagatttcacatggtattctgtgtgtcttagcactaccccactccacatttttatcaatgtttgtaataatatagaacttgtacttatcagattcccagaggatgacatgaagttggaagagataccatcagatgacagagttgggattcaagaagatcccagcagactagaacaatgagccaaacaagatcagaactgagtggggata

SEQ ID NO: 4769 - DNA, 397 bp, synthetic construct; identical to SEQ ID NO: 3335
  misc_feature 1..397: note = Synthetic polypeptide
  source 1..397: mol_type = other DNA

SEQ ID NO: 4770 - DNA, 289 bp, synthetic construct; identical to SEQ ID NO: 3336
  misc_feature 1..289: note = Synthetic polypeptide
  source 1..289: mol_type = other DNA

SEQ ID NO: 4771 - DNA, 3093 bp, synthetic construct; identical to SEQ ID NO: 341
  misc_feature 1..3093: note = Synthetic polypeptide
  source 1..3093: mol_type = other DNA

SEQ ID NO: 4772 - DNA, 2979 bp, synthetic construct; identical to SEQ ID NO: 342
  misc_feature 1..2979: note = Synthetic polypeptide
  source 1..2979: mol_type = other DNA

SEQ ID NO: 4773 - DNA, 3078 bp, synthetic construct; identical to SEQ ID NO: 343
  misc_feature 1..3078: note = Synthetic polypeptide
  source 1..3078: mol_type = other DNA

SEQ ID NO: 4774 - DNA, 3072 bp, synthetic construct; identical to SEQ ID NO: 346
  misc_feature 1..3072: note = Synthetic polypeptide
  source 1..3072: mol_type = other DNA

SEQ ID NO: 4775 - DNA, 1935 bp, synthetic construct; identical to SEQ ID NO: 347
  misc_feature 1..1935: note = Synthetic polypeptide
  source 1..1935: mol_type = other DNA

SEQ ID NO: 4776 - DNA, 1096 bp, synthetic construct; identical to SEQ ID NO: 348
  misc_feature 1..1096: note = Synthetic polypeptide
  source 1..1096: mol_type = other DNA

SEQ ID NO: 4777 - DNA, 902 bp, synthetic construct; identical to SEQ ID NO: 349
  misc_feature 1..902: note = Synthetic polypeptide
  source 1..902: mol_type = other DNA

SEQ ID NO: 4778 - DNA, 874 bp, synthetic construct; identical to SEQ ID NO: 350
  misc_feature 1..874: note = Synthetic polypeptide
  source 1..874: mol_type = other DNA

SEQ ID NO: 4779 - DNA, 442 bp, synthetic construct
  misc_feature 1..442: note = Synthetic polypeptide
  source 1..442: mol_type = other DNA
atggcgcggctcctctggttgctccggggcctgaccctcggaactgcgcctcggcgggcggtgcggggccaagcgggcggcggcgggcccggcaccgggccgggactgggggaggcagggtctcttgcaacgtgtgagctgcctcttgccaagagtgagtggcaaaagaaactaaccccggagcagttctacgtcacaagagaaaagggaacggaaccgcctttcagtgggatctacctgaataacaaggaagcaggaatgtatcattgcgtgtgctgcgacagtccactcttcagaagcttcctgaagtccttgccagaagcagatgccagcaccatgctgcttataaagcctgcagaactgtgagacaaataaatcttgtttctttataaattacccaggctcaggtatctctttatagcaatgcaaacagactaagaca

SEQ ID NO: 4780 - DNA, 324 bp, synthetic construct
  misc_feature 1..324: note = Synthetic polypeptide
  source 1..324: mol_type = other DNA
ggtctcttgcaacgtgtgagctgcctcttgccaagagtgagtggcaaaagaaactaaccccggagcagttctacgtcacaagagaaaagggaacggaaccgcctttcagtgggatctacctgaataacaaggaagcaggaatgtatcattgcgtgtgctgcgacagtccactcttcagaagcttcctgaagtccttgccagaagcagatgccagcaccatgctgcttataaagcctgcagaactgtgagacaaataaatcttgtttctttataaattacccaggctcaggtatctctttatagcaatgcaaacagactaagaca

SEQ ID NO: 4781 - DNA, 572 bp, synthetic construct; identical to SEQ ID NO: 159
  misc_feature 1..572: note = Synthetic polypeptide
  source 1..572: mol_type = other DNA

SEQ ID NO: 4782 - DNA, 624 bp, synthetic construct
  misc_feature 1..624: note = Synthetic polypeptide
  source 1..624: mol_type = other DNA
atggtgtgcgctcgggcggccctcggtcccggcgcgctctgggccgcggcctggggcgtcctgctgctcacagcccctgcgggggcgcagcgtggccggaagaaggtcgtgcacgtgctggagggtgagtcgggctcggtagtggtacagacagcgcctgggcaggtggtaagccaccgtggtggcaccatcgtcttgccctgccgctaccactatgaggcagccgcccacggtcacgacggcgtccggctcaagtggacaaaggtggtggacccgctggccttcaccgacgtcttcgtggcactaggcccccagcaccgggcattcggcagctaccgtgggcgggctgagctgcagggcgacgggcctggggatgcctccctggtcctccgcaacgtcacgctgcaagactacgggcgctatgagtgcgaagtcaccaatgagctggaagatgacgctggcatggtcaagctggacctggaagggacattggcgatgtctggagatattttacgttgtcacatctggagaaggcagttgctactagcccctagtgggtagaggccagggatgcagctatacatcctaccaggcacaggatagtcccccacaaggagtgatcca

SEQ ID NO: 4783 - DNA, 1288 bp, synthetic construct; identical to SEQ ID NO: 2642
  misc_feature 1..1288: note = Synthetic polypeptide
  source 1..1288: mol_type = other DNA

SEQ ID NO: 4784 - DNA, 625 bp, synthetic construct; identical to SEQ ID NO: 2643
  misc_feature 1..625: note = Synthetic polypeptide
  source 1..625: mol_type = other DNA

SEQ ID NO: 4785 - DNA, 700 bp, synthetic construct; identical to SEQ ID NO: 2644
  misc_feature 1..700: note = Synthetic polypeptide
  source 1..700: mol_type = other DNA

SEQ ID NO: 4786 - DNA, 778 bp, synthetic construct; identical to SEQ ID NO: 2645
  misc_feature 1..778: note = Synthetic polypeptide
  source 1..778: mol_type = other DNA

SEQ ID NO: 4787 - DNA, 238 bp, synthetic construct; identical to SEQ ID NO: 2646
  misc_feature 1..238: note = Synthetic polypeptide
  source 1..238: mol_type = other DNA

SEQ ID NO: 4788 - DNA, 1439 bp, synthetic construct
  misc_feature 1..1439: note = Synthetic polypeptide
  source 1..1439: mol_type = other DNA
atgcccgccctcagtcgctgggccagcctgcccggccccagcatgcgggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgggatgtccgaccgtggcgagcttgagaacgcagatctcgtggtgctctggaccgatggggacactgcctattttgcggacgcctggagtgaccagaaggggcagatccacctggatccccagcaggactaccagctgctgcaggtgcagaggaccccagaaggcctgaccctgcttttcaagaggccctttggcacctgcgaccccaaggattacctcattgaagacggcactgtccacttggtctacgggatcctggaggagccgttccggtcactggaggccatcaacggctcgggcctgcagatggggctgcagagggtgcagctcctgaagcccaatatccccgaaccggagttgccctcagacgcgtgcaccatggaggtccaagctcccaatatccagatccccagccaggagaccacgtactggtgctacattaaggagcttccaaagggcttctctcggcaccacattatcaagtacgagcccatcgtcaccaagggcaatgaggcccttgtccaccacatggaagtcttccagtgcgcccccgagatggacagcgtcccccacttcagcgggccctgcgactccaagatgaaacccgaccgcctcaactactgccgccacgtgctggccgcctgggccctgggtgccaaggcattttactacccagaggaagccggccttgccttcgggggtccagggtcctccagatatctccgcctggaagttcactaccacaacccactggtgatagaaggacgaaacgactcctcaggcatccgcttgtactacacagccaagctgcggcgcttcaacgcggggatcatggagctgggactggtgtacacgccagtgatggccattccaccacgggagaccgccttcatcctcactggctactgcacggacaagtgcacccagctggcactgcctccctccgggatccacatcttcgcctctcagctccacacacacctgactgggagaaaggtggtcacagtgctggtccgggacggccgggagtgggagatcgtgaaccaggacaatcactacagccctcacttccaggagatccgcatgttgaagaaggtcgtgtcggtccatccgggagatgtgctcatcacctcctgcacgtacaacacagaagaccgggagctggccacagtgggact

SEQ ID NO: 4789 - DNA, 3174 bp, synthetic construct; identical to SEQ ID NO: 1390
  misc_feature 1..3174: note = Synthetic polypeptide
  source 1..3174: mol_type = other DNA

SEQ ID NO: 4790 - DNA, 3024 bp, synthetic construct; identical to SEQ ID NO: 1391
  misc_feature 1..3024: note = Synthetic polypeptide
  source 1..3024: mol_type = other DNA

SEQ ID NO: 4791 - DNA, 3081 bp, synthetic construct; identical to SEQ ID NO: 1392
  misc_feature 1..3081: note = Synthetic polypeptide
  source 1..3081: mol_type = other DNA

SEQ ID NO: 4792 - DNA, 2985 bp, synthetic construct; identical to SEQ ID NO: 1393
  misc_feature 1..2985: note = Synthetic polypeptide
  source 1..2985: mol_type = other DNA

SEQ ID NO: 4793 - DNA, 2775 bp, synthetic construct; identical to SEQ ID NO: 1394
  misc_feature 1..2775: note = Synthetic polypeptide
  source 1..2775: mol_type = other DNA

SEQ ID NO: 4794 - DNA, 2949 bp, synthetic construct; identical to SEQ ID NO: 1395
  misc_feature 1..2949: note = Synthetic polypeptide
  source 1..2949: mol_type = other DNA

SEQ ID NO: 4795 - DNA, 1590 bp, synthetic construct; identical to SEQ ID NO: 1396
  misc_feature 1..1590: note = Synthetic polypeptide
  source 1..1590: mol_type = other DNA

SEQ ID NO: 4796 - DNA, 849 bp, synthetic construct; identical to SEQ ID NO: 1397
  misc_feature 1..849: note = Synthetic polypeptide
  source 1..849: mol_type = other DNA

SEQ ID NO: 4797 - DNA, 2216 bp, synthetic construct
  misc_feature 1..2216: note = Synthetic polypeptide
  source 1..2216: mol_type = other DNA
atgggagcagtaagctgtcggcaggggcagcacacccagcagggggaacacacccgggtggctgtccctcacaagcagggtggcaacatccggggtccctgggcccgaggctggaagagcctctggacaggtttgggaaccatcaggtcagatctggaagaactctgggaactacgggggcaccactatctgcaccaggaatccctaaagccagccccagtactggtagagaagcctctgccagagtggccagtgcctcagttcatcaacctctttctaccagagtttcccattaggcccattagggggcagcagcagctgaagattttaggcctcgtggctaaaggctcctttggaactgtcctcaaggtgctagattgcacccagaaagctgtatttgcagtgaaggtggtgcccaaggtaaaggtcctacagagggataccgtgaggcagtgcaaagaggaggttagcatccagctggactgtgctgctgccatctcggctcactgcaacctccctgcctgattctcctgactcagcctgtcgagtgcctgcgattgcaggcgcgcggcgccatgcctgactggttttcgtatttttttggtggagacggggtttcgctgtgttggccggactggtctccagctcctaactgcgagtgatccgccagcctcggcctcccgaggtgccgggattgcagacggagtctcgttaactcagtgctcagtggtgcccaggctggagtgcagtggcgtgatctcggctcgctacaacctccacctcccagccgcctgccttggccccccaaagtgccgagattgcagcctctgcccggacgccaccccgtctgggaagtgaggagcgtctctgcctggccgcccatcgtctgggatgtgaggagcccctctgcctggctgcccagtctggaaggtgaggagcgtctctgcccggccgccatcccacctaggaagtgaggagcacctcttcccggccaccatcccatctaggaagtgaggagcgtctctgcccggctgcccatcgtctgagatgtggggagcgcctctgccccgccgccccgtctgggatgtgaggagcgccttggcccggccgtgaccccgtctgggaggtgaggagcgtctctgcccggccaccccgtctgagaagtgaggagaccctccgcccggcaactgccccgtctgagaagtgaggagcccctccgcccggcagccgccccgtctgagaagtgaggagcccctccgcccggctgccaccccgtctgggaagtgaggagcgtctccgcccagcagccaccccgtccgggagggaggtgggggtcagcccccgccaggccagctgccccatccgggagggaggtggggtgtcagccccctgcccggccagccgccccgtccgggaggtgaggggcgcctctgcccggctgcccctactgggaagtgaggagcccctctgcccggccagccgccccgtccgggagggaggtgggggagtcagccccccgcccggccagccgccccttccaggagggaggtggggggttcagcccaccgcccggccagccgccccgtccgggagggaggtgggggggtcagccccccgcccggccagccgccccgtctgggaggtgaggggcgcctctgcccggctgcccctgctgggaagtgaggagcccctctgctgggccaccaccccgtctgggaggtgtacccagcagctcattgagaacgggccatgatgacaatggcggttttgtggaatagaaaggggggaaaggtggggaaaagattgagaaatcggatggttgctgtgtctgtgtagagggaggtagacatgggagacttttcattttgttctgtactaagaaaaattcttctgccttgggatcctgttgatctatgaccttacccccaaccctgtgctctctaaaacatgtgctgtgtccactcagggttaaatggattaagggcggtgcaagatgtgctttgttaaacagatgcttgaaggcagcatgcttgttaagagtcatcaccactccctaatcgcaagtacccagggacacaaacactctgcctaggaaaaccagagacctttgttcacttgtttatctgctgaccttccttccactattgtcctatgaccctgccaaatccccctctgcgagaaacacccaagaatgatcaataaaaaataaaataaaa

SEQ ID NO: 4798 - DNA, 2213 bp, synthetic construct
  misc_feature 1..2213: note = Synthetic polypeptide
  source 1..2213: mol_type = other DNA
atgggagcagtaagctgtcggcaggggcagcacacccagcagggggaacacacccgggtggctgtccctcacaagggtggcaacatccggggtccctgggcccgaggctggaagagcctctggacaggtttgggaaccatcaggtcagatctggaagaactctgggaactacgggggcaccactatctgcaccaggaatccctaaagccagccccagtactggtagagaagcctctgccagagtggccagtgcctcagttcatcaacctctttctaccagagtttcccattaggcccattagggggcagcagcagctgaagattttaggcctcgtggctaaaggctcctttggaactgtcctcaaggtgctagattgcacccagaaagctgtatttgcagtgaaggtggtgcccaaggtaaaggtcctacagagggataccgtgaggcagtgcaaagaggaggttagcatccagctggactgtgctgctgccatctcggctcactgcaacctccctgcctgattctcctgactcagcctgtcgagtgcctgcgattgcaggcgcgcggcgccatgcctgactggttttcgtatttttttggtggagacggggtttcgctgtgttggccggactggtctccagctcctaactgcgagtgatccgccagcctcggcctcccgaggtgccgggattgcagacggagtctcgttaactcagtgctcagtggtgcccaggctggagtgcagtggcgtgatctcggctcgctacaacctccacctcccagccgcctgccttggccccccaaagtgccgagattgcagcctctgcccggacgccaccccgtctgggaagtgaggagcgtctctgcctggccgcccatcgtctgggatgtgaggagcccctctgcctggctgcccagtctggaaggtgaggagcgtctctgcccggccgccatcccacctaggaagtgaggagcacctcttcccggccaccatcccatctaggaagtgaggagcgtctctgcccggctgcccatcgtctgagatgtggggagcgcctctgccccgccgccccgtctgggatgtgaggagcgccttggcccggccgtgaccccgtctgggaggtgaggagcgtctctgcccggccaccccgtctgagaagtgaggagaccctccgcccggcaactgccccgtctgagaagtgaggagcccctccgcccggcagccgccccgtctgagaagtgaggagcccctccgcccggctgccaccccgtctgggaagtgaggagcgtctccgcccagcagccaccccgtccgggagggaggtgggggtcagcccccgccaggccagctgccccatccgggagggaggtggggtgtcagccccctgcccggccagccgccccgtccgggaggtgaggggcgcctctgcccggctgcccctactgggaagtgaggagcccctctgcccggccagccgccccgtccgggagggaggtgggggagtcagccccccgcccggccagccgccccttccaggagggaggtggggggttcagcccaccgcccggccagccgccccgtccgggagggaggtgggggggtcagccccccgcccggccagccgccccgtctgggaggtgaggggcgcctctgcccggctgcccctgctgggaagtgaggagcccctctgctgggccaccaccccgtctgggaggtgtacccagcagctcattgagaacgggccatgatgacaatggcggttttgtggaatagaaaggggggaaaggtggggaaaagattgagaaatcggatggttgctgtgtctgtgtagagggaggtagacatgggagacttttcattttgttctgtactaagaaaaattcttctgccttgggatcctgttgatctatgaccttacccccaaccctgtgctctctaaaacatgtgctgtgtccactcagggttaaatggattaagggcggtgcaagatgtgctttgttaaacagatgcttgaaggcagcatgcttgttaagagtcatcaccactccctaatcgcaagtacccagggacacaaacactctgcctaggaaaaccagagacctttgttcacttgtttatctgctgaccttccttccactattgtcctatgaccctgccaaatccccctctgcgagaaacacccaagaatgatcaataaaaaataaaataaaa

SEQ ID NO: 4799 - DNA, 5394 bp, synthetic construct; identical to SEQ ID NO: 3213
  misc_feature 1..5394: note = Synthetic polypeptide
  source 1..5394: mol_type = other DNA

SEQ ID NO: 4800 - DNA, 5259 bp, synthetic construct; identical to SEQ ID NO: 3214
  misc_feature 1..5259: note = Synthetic polypeptide
  source 1..5259: mol_type = other DNA

SEQ ID NO: 4801 - DNA, 5409 bp, synthetic construct; identical to SEQ ID NO: 3215
  misc_feature 1..5409: note = Synthetic polypeptide
  source 1..5409: mol_type = other DNA

SEQ ID NO: 4802 - DNA, 5403 bp, synthetic construct; identical to SEQ ID NO: 3216
  misc_feature 1..5403: note = Synthetic polypeptide
  source 1..5403: mol_type = other DNA

SEQ ID NO: 4803 - DNA, 272 bp, synthetic construct; identical to SEQ ID NO: 3217
  misc_feature 1..272: note = Synthetic polypeptide
  source 1..272: mol_type = other DNA

SEQ ID NO: 4804 - DNA, 917 bp, synthetic construct; identical to SEQ ID NO: 2352
  misc_feature 1..917: note = Synthetic polypeptide
  source 1..917: mol_type = other DNA

SEQ ID NO: 4805 - DNA, 1808 bp, synthetic construct; identical to SEQ ID NO: 3239
  misc_feature 1..1808: note = Synthetic polypeptide
  source 1..1808: mol_type = other DNA

SEQ ID NO: 4806 - DNA, 788 bp, synthetic construct; identical to SEQ ID NO: 3240
  misc_feature 1..788: note = Synthetic polypeptide
  source 1..788: mol_type = other DNA

SEQ ID NO: 4807 - DNA, 1589 bp, synthetic construct; identical to SEQ ID NO: 3241
  misc_feature 1..1589: note = Synthetic polypeptide
  source 1..1589: mol_type = other DNA

SEQ ID NO: 4808 - DNA, 986 bp, synthetic construct; identical to SEQ ID NO: 3242
  misc_feature 1..986: note = Synthetic polypeptide
  source 1..986: mol_type = other DNA

SEQ ID NO: 4809 - DNA, 389 bp, synthetic construct
  misc_feature 1..389: note = Synthetic polypeptide
  source 1..389: mol_type = other DNA
atgtgcaaaggacttgcagctttgccccactcatgcctggaaagggccaaggagattaagatcaagttgggaattctcctccagaagccagactcagttggtgaccttgtcattccgtacaatgagaagccagagaaaccagccaagacccagaaaacctcgctggacgaggccctgcagtggcgtgattccctggacaaactcctgcagaacaactatggacttgccagtttcaaaagtttcctgaagtctgaattcagtgaggaaaaccttgagttctggattgcctgtgaggattacaagaagatcaagtcccctgccaagatggctgagaaggcaaagcaaatttatgaagaattcattcaaacggaggctcctaaagaggagaa

SEQ ID NO: 4810 - DNA, 449 bp, synthetic construct
  misc_feature 1..449: note = Synthetic polypeptide
  source 1..449: mol_type = other DNA
atgtgcgcaagaaacatttcacaggatattctcatcttacagatgcacagtgctcattggcatatcaatggcaaatatgaggaaaagagtaacctgatgttctgggccaaggagattaagatcaagttgggaattctcctccagaagccagactcagttggtgaccttgtcattccgtacaatgagaagccagagaaaccagccaagacccagaaaacctcgctggacgaggccctgcagtggcgtgattccctggacaaactcctgcagaacaactatggacttgccagtttcaaaagtttcctgaagtctgaattcagtgaggaaaaccttgagttctggattgcctgtgaggattacaagaagatcaagtcccctgccaagatggctgagaaggcaaagcaaatttatgaagaattcattcaaacggaggctcctaaagaggagaa

SEQ ID NO: 4811 - DNA, 65 bp, synthetic construct
  misc_feature 1..65: note = Synthetic polypeptide
  source 1..65: mol_type = other DNA
atggctgagaaggcaaagcaaatttatgaagaattcattcaaacggaggctcctaaagaggagaa

SEQ ID NO: 4812 - DNA, 178 bp, synthetic construct
  misc_feature 1..178: note = Synthetic polypeptide
  source 1..178: mol_type = other DNA
atgtggaatctccttcacgaaaccgactcggctgtggccaccgcgcgccgcccgcgctggctgtgcgctggggcgctggtgctggcgggtggcttctttctcctcggcttcctcttcggttaaaagccaactgcaaggtctaatgactgcaggatctagctatccattgtttctggcc

SEQ ID NO: 4813 - DNA, 2616 bp, synthetic construct
  misc_feature 1..2616: note = Synthetic polypeptide
  source 1..2616: mol_type = other DNA
atgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatgttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagatgggaccatctagttgcaggaaaacaagctcagggatcccactgattctacattatggtaagttgtataattatttcattatatattaccacataataatagaaataaagtacacaataaatgtaatgggcttgaatcatcctgaaactacctccatcgccatccatggaaaaattgtcctccgcgaaaccagtccctggtgccaaaaaggttgaggactg

SEQ ID NO: 4814 - DNA, 2757 bp, synthetic construct
  misc_feature 1..2757: note = Synthetic polypeptide
  source 1..2757: mol_type = other DNA
atgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagatgggaccatctagttgcaggaaaacaagctcagggatcccactgattctacattatggtaagttgtataattatttcattatatattaccacataataatagaaataaagtacacaataaatgtaatgggcttgaatcatcctgaaactacctccatcgccatccatggaaaaattgtcctccgcgaaaccagtccctggtgccaaaaaggttgaggactg

SEQ ID NO: 4815 - DNA, 2532 bp, synthetic construct
  misc_feature 1..2532: note = Synthetic polypeptide
  source 1..2532: mol_type = other DNA
atgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagatgggaccatctagttgcaggaaaacaagctcagggatcccactgattctacattatggtaagttgtataattatttcattatatattaccacataataatagaaataaagtacacaataaatgtaatgggcttgaatcatcctgaaactacctccatcgccatccatggaaaaattgtcctccgcgaaaccagtccctggtgccaaaaaggttgaggactg

SEQ ID NO: 4816 - DNA, 794 bp, synthetic construct
  misc_feature 1..794: note = Synthetic polypeptide
  source 1..794: mol_type = other DNA
atgggcagcgccagcccgggtctgagcagcgtatcccccagccacctcctgctgccccccgacacggtgtcgcggacaggcttggagaaggcggcagcgggggcagtgggtctcgagagacgggactggagtcccagtccacccgccacgcccgagcagggcctgtccgccttctacctctcctactttgacatgctgtaccctgaggacagcagctgggcagccaaggcccctggggccagcagtcgggaggagccacctgaggagcctgagcagtgcccggtcattgacagccaagccccagcgggcagcctggacttggtgcccggcgggctgaccttggaggagcactcgctggagcaggtgcagtccatggtggtgggcgaagtgctcaaggacatcgagacggcctgcaagctgctcaacatcaccgcaggtcttggctcagatggcaccatccgcatgaggccttccctgacccctccattaaaattgctgcccatgagcacaggacatggtaaagaaaacaaacaaaaaaatgaaaaataaaagaaagaagaaaaatttctgctcacatccctacctgctgttctcacctgcttcctctcatagcacttacactcctcggacgtgccgcaccatatctgttgatctcgctcactctctgtgtcctccactagaatgtacactccacaaaggcagggattttcatttgttttgctcatcaatccatccccagatgctaggatagcaccttgaatataactgatgctcaatagacagttgttcaataa

SEQ ID NO: 4817 - DNA, 488 bp, synthetic construct
  misc_feature 1..488: note = Synthetic polypeptide
  source 1..488: mol_type = other DNA
atggcactgcagggcatctcggtcgtggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcgtgaatgcctgaatctcaaacttgtacttcatcatggactccagtcttcctttcacatccaatttcaatgatcatcaatacagtcattttgctccttagcccactcggactatttctctccatacctgctgcaactgccttgacactggtgtgacagccttttaaaaactggtgtttggggctggtatcactccagtggattctcagacagctgccagaataactttgttcaagtagaaatc

SEQ ID NO: 4818 - DNA, 1081 bp, synthetic construct; identical to SEQ ID NO: 986
  misc_feature 1..1081: note = Synthetic polypeptide
  source 1..1081: mol_type = other DNA

SEQ ID NO: 4819 - DNA, 1054 bp, synthetic construct; identical to SEQ ID NO: 987
  misc_feature 1..1054: note = Synthetic polypeptide
  source 1..1054: mol_type = other DNA

SEQ ID NO: 4820 - DNA, 1334 bp, synthetic construct
  misc_feature 1..1334: note = Synthetic polypeptide
  source 1..1334: mol_type = other DNA
atggtgcagtacgagctgtgggccgcgctgcctggcgcctccggggtcgccctggcctgctgcttcgtggcggcggccgtggccctgcgctggtccgggcgccggacggcgcggggcgcggtggtccgggcgcgacagaggcagcgagcgggcctggagaacatggacagggcggcgcagcgcttccggctccagaacccagacctggactcagaggcgctgctagccctgcccctgcctcagctggtgcagaagttacacagtagagagctggcccctgaggccgtgctcttcacctatgtgggaaaggcctgggaagtgaacaaagggaccaactgtgtgacctcctatctggctgactgtgagactcagctgtctcaggccccaaggcagggcctgctctatggcgtccctgtgagcctcaaggagtgcttcacctacaagggccaggactccacgctgggcttgagcctgaatgaaggggtgccggcggagtgcgacagcgtagtggtgcatgtgctgaagctgcagggtgccgtgcccttcgtgcacaccaatgttccacagtccatgttcagctatgactgcagtaaccccctctttggccagaccgtgaacccatggaagtcctccaaaagcccagggggctcctcagggggtgaaggggccctcatcgggtctggaggctcccccctgggcttaggcactgatatcggaggcagcatccgcttcccctcctccttctgcggcatctgcggcctcaagcccacagggaaccgcctcagcaagagtggcctgaagggctgtgtctatggacaggaggcagtgcgtctctccgtgggccccatggcccgggacgtggagagcctggcactgtgcctgcgagccctgctgtgtgaggacatgttccgcttggaccccactgtgcctcccttgcccttcagagaagaggtctacaccagctctcagcccctgcgtgtggggtactatgagactgacaactataccatgccctccccggccatgaggcgggccgtgctggagaccaaacagagccttgaggctgcggggcacacgctggttcccttcttgccaagcaacataccccatgctctggagaccctgtcaacaggtgggctcttcagtgatggtggccacaccttcctacagaacttcaaaggtgatttcgtggacccctgcctgggggacctggtctcaattctgaagcttccccaatggcttaaaggactgctggccttcctggtgaagcctctgctgccaaggctgtcagctttcctcagcaacatgaagtctcgacagtaggggtttgaact

SEQ ID NO: 4821 - DNA, 262 bp, synthetic construct
  misc_feature 1..262: note = Synthetic polypeptide
  source 1..262: mol_type = other DNA
atgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaaccagtgtgtctcaccctgtatctctctgccaggctctgtctctcggtctctgtctc

SEQ ID NO: 4822 - DNA, 246 bp, synthetic construct
  misc_feature 1..246: note = Synthetic polypeptide
  source 1..246: mol_type = other DNA
tcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaaccagtgtgtctcaccctgtatctctctgccaggctctgtctctcggtctctgtctc

SEQ ID NO: 4823 - DNA, 205 bp, synthetic construct
  misc_feature 1..205: note = Synthetic polypeptide
  source 1..205: mol_type = other DNA
atgtgggtcccggttgtcttcctcaccctgtccgtgacgtggattgcaccccctctgcaggtgcttgtggcctctcgtggcagggcagtctgcggcggtgttctggtgcacccccagtgggtcctcacagctgcccactgcatcaggaaccagtgtgtctcaccctgtatctctctgccaggctctgtctctcggtctctgtctc

SEQ ID NO: 4824 - DNA, 151 bp, synthetic construct
  misc_feature 1..151: note = Synthetic polypeptide
  source 1..151: mol_type = other DNA
atgtgggtcccggttgtcttcctcaccctggcagtctgcggcggtgttctggtgcacccccagtgggtcctcacagctgcccactgcatcaggaaccagtgtgtctcaccctgtatctctctgccaggctctgtctctcggtctctgtctc

SEQ ID NO: 4825 - DNA, 1063 bp, synthetic construct; identical to SEQ ID NO: 2221
  misc_feature 1..1063: note = Synthetic polypeptide
  source 1..1063: mol_type = other DNA

SEQ ID NO: 4826 - DNA, 1224 bp, synthetic construct
  misc_feature 1..1224: note = Synthetic polypeptide
  source 1..1224: mol_type = other DNA
atggcactgcagggcatctcggtcgtggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaagtgacattattcacaatagccaagaggtagaagcaactcaagtgtccatcaacagatgaatggatgaacaaaatgtggtacagacataaaatggaatgtgattcagcctgaaaaaaacaagaaaattccaacacgttacaacagagatgaatcttgaagacattatgctgagtgaaataagtcagtcaccaaagggctaatactgtatgattctactacatgaaatgtctaaagtggtcaagttcatagagacagaaagtagaatggtgcttgccagaggctgtggggaggtaggagcgggagttagtgtttactgggttcagagtttctgtttgaaaagttgaaaaagttcaggagttgtgtggtacagatggatggtggtgatagatgtaaagcagtatgagtgtacttaatgccctagtactgtacaccaaaaaatggctgaaatggtaaactttatgtatattttaccacaattttcaaaaa

SEQ ID NO: 4827 - DNA, 1063 bp, synthetic construct
  misc_feature 1..1063: note = Synthetic polypeptide
  source 1..1063: mol_type = other DNA
atggcactgcagggcatctcggtcgtggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaagtgacattattcacaatagccaagaggtagaagcaactcaagtgtccatcaacagatgaatggatgaacaaaatgtggtacagacataaaatggaatgtgattcagcctgaaaaaaacaagaaaattccaacacgttacaacagagatgaatcttgaagacattatgctgagtgaaataagtcagtcaccaaagggctaatactgtatgattctactacatgaaatgtctaaagtggtcaagttcatagagacagaaagtagaatggtgcttgccagaggctgtggggaggtaggagcgggagttagtgtttactgggttcagagtttctgtttgaaaagttgaaaaagttcaggagttgtgtggtacagatggatggtggtgatagatgtaaagcagtatgagtgtacttaatgccctagtactgtacaccaaaaaatggctgaaatggtaaactttatgtatattttaccacaattttcaaaaa

SEQ ID NO: 4828 - DNA, 1179 bp, synthetic construct
  misc_feature 1..1179: note = Synthetic polypeptide
  source 1..1179: mol_type = other DNA
atggcactgcagggcatctcggtcgtggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatgaaattgagtctgtgggaagcacctcgaggacagaacatgttggatggtggagcacctttctatacgacttacaggacagcagatggggaattcatggctgttggagcaatagaaccccagttctacgagctgctgatcaaagtgacattattcacaatagccaagaggtagaagcaactcaagtgtccatcaacagatgaatggatgaacaaaatgtggtacagacataaaatggaatgtgattcagcctgaaaaaaacaagaaaattccaacacgttacaacagagatgaatcttgaagacattatgctgagtgaaataagtcagtcaccaaagggctaatactgtatgattctactacatgaaatgtctaaagtggtcaagttcatagagacagaaagtagaatggtgcttgccagaggctgtggggaggtaggagcgggagttagtgtttactgggttcagagtttctgtttgaaaagttgaaaaagttcaggagttgtgtggtacagatggatggtggtgatagatgtaaagcagtatgagtgtacttaatgccctagtactgtacaccaaaaaatggctgaaatggtaaactttatgtatattttaccacaattttcaaaaa

SEQ ID NO: 4829 - DNA, 496 bp, synthetic construct; identical to SEQ ID NO: 2667
  misc_feature 1..496: note = Synthetic polypeptide
  source 1..496: mol_type = other DNA

SEQ ID NO: 4830 - DNA, 425 bp, synthetic construct
  misc_feature 1..425: note = Synthetic polypeptide
  source 1..425: mol_type = other DNA
atgcctcgcctgttcttgttccacctgctagaattctgtttactactgaaccaattttccagagcagtcgcggccaaatggaaggacgatgttattaaattatgcggccgcgaattagttcgcgcgcagattgccatttgcggcatgagcacctggagcaaaaggtctctgagccaggaagatgctcctcagacacctagaccagtggcagaaattgtaccatccttcatcaacaaagatacagaaactataattatcatgttggaattcattgctaatttgccaccggagctgaaggcagccctatctgagaggcaaccatcattaccagagctacagcacctaaaagagttaatggtttcctgctactgtcagcccctgggtgccttttcatcccttgaggttaccattgacactactcaaac

SEQ ID NO: 4831 - DNA, 1038 bp, synthetic construct
  misc_feature 1..1038: note = Synthetic polypeptide
  source 1..1038: mol_type = other DNA
atgacagaacaggagaccctggccctactggaagtgaagaggtctgattccccagagaagagctcaccccaggccttggttcccaatggccggcagccagaaggggaaggtggggccgaatccccgggagctgagtccctcagagtggggtcttcagctggatctcccacagccatagagggggctgaggatggtctagacagcacagtaagtgaggctgccaccttgccctgggggactggccctcagcccagtgctccgttcccggatccccctggctggcgggacattgaaccagagccccctgagtcagaaccacttaccaagctagaggagctgcccgaagacgatgccaacctgctgcctgagaaagcggcccgtgccttcgtgcctattgacctacagtgcattgagcggcagccccaagaagaccttatcgtgcgctgtgaggcaggcgagggcgagtgccgaaccttcatgcccccccgggtcacccaccccgaccccactgagcgcaagtgggctgaggcagtggtgaggccgcctggctgttcctgtgggggctgcgggagctgtggagaccgtgagtggctaagggctgtggcctccgtgggagccgcactcattctcttcccttgcctactatacggggcatatgccttcctgccgtttgatgtcccacggctgcccaccatgagttcccgcctgatctacacactgcgctgcggggtctttgccaccttccccattgtgctggggatcctggtgtacgggctgagcctgttatgcttttctgcccttcggccctttggggagccacggcgggaggtggagatccaccggcgatatgtggcccagtcggtccagctctttattctctacttcttcaacctggccgtgctttccacttacctgccccaggataccctcaaactgctccctctgctcactggtctctttgccgtctcccgatgtgtgatcttggaccagtcttacttaacccttggaatcttagtttcttcatctgcaagaggataa

SEQ ID NO: 4832 - DNA, 322 bp, synthetic construct
  misc_feature 1..322: note = Synthetic polypeptide
  source 1..322: mol_type = other DNA
atgacagaacaggagaccctggccctactggaagtgaagagggatcctggtgtacgggctgagcctgttatgcttttctgcccttcggccctttggggagccacggcgggaggtggagatccaccggcgatatgtggcccagtcggtccagctctttattctctacttcttcaacctggccgtgctttccacttacctgccccaggataccctcaaactgctccctctgctcactggtctctttgccgtctcccgatgtgtgatcttggaccagtcttacttaacccttggaatcttagtttcttcatctgcaagaggataa

SEQ ID NO: 4833 - DNA, 276 bp, synthetic construct; identical to SEQ ID NO: 923
  misc_feature 1..276: note = Synthetic polypeptide
  source 1..276: mol_type = other DNA

SEQ ID NO: 4834 - DNA, 483 bp, synthetic construct; identical to SEQ ID NO: 2246
  misc_feature 1..483: note = Synthetic polypeptide
  source 1..483: mol_type = other DNA

SEQ ID NO: 4835 - DNA, 914 bp, synthetic construct; identical to SEQ ID NO: 931
  misc_feature 1..914: note = Synthetic polypeptide
  source 1..914: mol_type = other DNA

SEQ ID NO: 4836 - DNA, 251 bp, synthetic construct; identical to SEQ ID NO: 932
  misc_feature 1..251: note = Synthetic polypeptide
  source 1..251: mol_type = other DNA

SEQ ID NO: 4837 - DNA, 1016 bp, synthetic construct; identical to SEQ ID NO: 933
  misc_feature 1..1016: note = Synthetic polypeptide
  source 1..1016: mol_type = other DNA

SEQ ID NO: 4838 - DNA, 3516 bp, synthetic construct; identical to SEQ ID NO: 2247
  misc_feature 1..3516: note = Synthetic polypeptide
  source 1..3516: mol_type = other DNA

SEQ ID NO: 4839 - DNA, 3648 bp, synthetic construct; identical to SEQ ID NO: 2248
  misc_feature 1..3648: note = Synthetic polypeptide
  source 1..3648: mol_type = other DNA

SEQ ID NO: 4840 - DNA, 3555 bp, synthetic construct; identical to SEQ ID NO: 2249
  misc_feature 1..3555: note = Synthetic polypeptide
  source 1..3555: mol_type = other DNA

SEQ ID NO: 4841 - DNA, 3552 bp, synthetic construct; identical to SEQ ID NO: 2250
  misc_feature 1..3552: note = Synthetic polypeptide
  source 1..3552: mol_type = other DNA

SEQ ID NO: 4842 - DNA, 3669 bp, synthetic construct; identical to SEQ ID NO: 2251
  misc_feature 1..3669: note = Synthetic polypeptide
  source 1..3669: mol_type = other DNA

SEQ ID NO: 4843 - DNA, 3687 bp, synthetic construct; identical to SEQ ID NO: 2252
  misc_feature 1..3687: note = Synthetic polypeptide
  source 1..3687: mol_type = other DNA

SEQ ID NO: 4844 - DNA, 3594 bp, synthetic construct; identical to SEQ ID NO: 2253
  misc_feature 1..3594: note = Synthetic polypeptide
  source 1..3594: mol_type = other DNA

SEQ ID NO: 4845 - DNA, 3537 bp, synthetic construct; identical to SEQ ID NO: 2254
  misc_feature 1..3537: note = Synthetic polypeptide
  source 1..3537: mol_type = other DNA

SEQ ID NO: 4846 - DNA, 3558 bp, synthetic construct; identical to SEQ ID NO: 2255
  misc_feature 1..3558: note = Synthetic polypeptide
  source 1..3558: mol_type = other DNA

SEQ ID NO: 4847 - DNA, 3297 bp, synthetic construct; identical to SEQ ID NO: 2256
  misc_feature 1..3297: note = Synthetic polypeptide
  source 1..3297: mol_type = other DNA

SEQ ID NO: 4848 - DNA, 3776 bp, synthetic construct
  misc_feature 1..3776: note = Synthetic polypeptide
  source 1..3776: mol_type = other DNA
atgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatgttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttatcatcttctctccaggggctctggaccatccgggcatacaaagcagaagagaggtgtcaggaactgtttgatgcacaccaggatttacattcagaggcttggttcttgtttttgacaacgtcccgctggtttgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacagggaggaaccaggtggaagtgatgattggatcattggagcggcttccc

SEQ ID NO: 4849 - DNA, 3917 bp, synthetic construct
  misc_feature 1..3917: note = Synthetic polypeptide
  source 1..3917: mol_type = other DNA
atgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttatcatcttctctccaggggctctggaccatccgggcatacaaagcagaagagaggtgtcaggaactgtttgatgcacaccaggatttacattcagaggcttggttcttgtttttgacaacgtcccgctggtttgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacagggaggaaccaggtggaagtgatgattggatcattggagcggcttccc

SEQ ID NO: 4850 - DNA, 1526 bp, synthetic construct
  misc_feature 1..1526: note = Synthetic polypeptide
  source 1..1526: mol_type = other DNA
atgatgatgatgatgatgatgaaaaaaatgcagcatcaacggcagcagcaagcggaccacgcgaacgaggcaaactatgcaagaggcaccagacttcctctttctggtgaaggaccaacttctcagccgaatagctccaagcaaactgtcctgtcttggcaagctgcaatcgatgctgctagacaggccaaggctgcccaaactatgagcacctctgcacccccacctgtaggatctctctcccaaagaaaacgtcagcaatacgccaagagcaaaaaacagggtaactcgtccaacagccgacctgcccgcgcccttttctgtttatcactcaataaccccatccgaagagcctgcattagtatagtggaatggaaaccatttgacatatttatattattggctatttttgccaattgtgtggccttagctatttacatcccattccctgaagatgattctaattcaacaaatcataacttggaaaaagtagaatatgccttcctgattatttttacagtcgagacatttttgaagattatagcgtatggattattgctacatcctaatgcttatgttaggaatggatggaatttactggattttgttatagtaatagtaggattgtttagtgtaattttggaacaattaaccaaagaaacagaaggcgggaaccactcaagcggcaaatctggaggctttgatgtcaaagccctccgtgcctttcgagtgttgcgaccacttcgactagtgtcaggagtgcccagtttacaagttgtcctgaactccattataaaagccatggttcccctccttcacatagcccttttggtattatttgtaatcataatctatgctattataggattggaactttttattggaaaaatgcacaaaacatgtttttttgctgactcagatatcgtagctgaagaggacccagctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagatgtgctctactggatgaatgatgctatgggatttgaattgccctgggtgtattttgtcagtctcgtcatctttgggtcatttttcgtactaaatcttgtacttggtgtattgagcgggcacagtggctcacgcctataatcccagcactttcggaggccgaggcagctggaccacccgagatcaggagtttgagaccagcctgactaaggcagtgaaaccctgtctctactaaaaatacaaaaattagccaggcatggtggcgcatgcctgtaatcccagctacttgggaggctgaggcaggagaatcacttgaaccagggaggtggagattgcagtgagccaagactgcaccattgcattccagcctgggtgacaagagcaaaactccatctcaaaaaaaaaaaaaaaaaaaaaaaaaaaaa

SEQ ID NO: 4851 - DNA, 545 bp, synthetic construct
  misc_feature 1..545: note = Synthetic polypeptide
  source 1..545: mol_type = other DNA
gccaatggcacggaatgtaggagtggctgggttggcccgaacggaggcatcaccaactttgataactttgcctttgccatgcttactgtgtttcagtgcatcaccatggagggctggacagatgtgctctactggatgaatgatgctatgggatttgaattgccctgggtgtattttgtcagtctcgtcatctttgggtcatttttcgtactaaatcttgtacttggtgtattgagcgggcacagtggctcacgcctataatcccagcactttcggaggccgaggcagctggaccacccgagatcaggagtttgagaccagcctgactaaggcagtgaaaccctgtctctactaaaaatacaaaaattagccaggcatggtggcgcatgcctgtaatcccagctacttgggaggctgaggcaggagaatcacttgaaccagggaggtggagattgcagtgagccaagactgcaccattgcattccagcctgggtgacaagagcaaaactccatctcaaaaaaaaaaaaaaaaaaaaaaaaaaaaa

SEQ ID NO: 4852 - DNA, 937 bp, synthetic construct
  misc_feature 1..937: note = Synthetic polypeptide
  source 1..937: mol_type = other DNA
atgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaaggggacagttcacttaatcactcttgcaccagcttccattctgcaaaatggggatattaatgatacctacttcatagacagtgagtattaaaatgaatgtatgtattcaaatggcttagagcaaacagtacctggtacataatacactgtcaataaatgt

SEQ ID NO: 4853 - DNA, 838 bp, synthetic construct
  misc_feature 1..838: note = Synthetic polypeptide
  source 1..838: mol_type = other DNA
atgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaaggggacagttcacttaatcactcttgcaccagcttccattctgcaaaatggggatattaatgatacctacttcatagacagtgagtattaaaatgaatgtatgtattcaaatggcttagagcaaacagtacctggtacataatacactgtcaataaatgt

SEQ ID NO: 4854 - DNA, 3719 bp, synthetic construct
  misc_feature 1..3719: note = Synthetic polypeptide
  source 1..3719: mol_type = other DNA
atggtggtgccggagaaggagcagagctggatccccaagatcttcaagaagaagacctgcacgacgttcatagttgactccacagatccgggagggaccttgtgccagtgtgggcgcccccggaccgcccaccccgcagtggccatggaggatgccttcggggcagccgtggtgaccgtgtgggacagcgatgcacacaccacggagaagcccaccgatgcctacggagagctggacttcacgggggccggccgcaagcacagcaatttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaaggcctgtgggagctcggaggcctcagcctacctggatgagctgcgtttggctgtggcttggaaccgcgtggacattgcccagagtgaactctttcggggggacatccaatggcggtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaaggacccagggatggagcagtgtcctcactcattgcactcaccctacccaggatctgtaagtaataaatcttggaccttat

SEQ ID NO: 4855 - DNA, 3284 bp, synthetic construct
  misc_feature 1..3284: note = Synthetic polypeptide
  source 1..3284: mol_type = other DNA
atggtggtgccggagaaggagcagagctggatccccaagatcttcaagaagaagacctgcacgacgttcatagttgactccacagatccgggagggaccttgtgccagtgtgggcgcccccggaccgcccaccccgcagtggccatggaggatgccttcggggcagccgtggtgaccgtgtgggacagcgatgcacacaccacggagaagcccaccgatgcctacggagagctggacttcacgggggccggccgcaagcacagcaatttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaaggcctgtgggagctcggaggcctcagcctacctggatgagctgcgtttggctgtggcttggaaccgcgtggacattgcccagagtgaactctttcggggggacatccaatggcggtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaaggacccagggatggagcagtgtcctcactcattgcactcaccctacccaggatctgtaagtaataaatcttggaccttat

SEQ ID NO: 4856 - DNA, 2657 bp, synthetic construct
  misc_feature 1..2657: note = Synthetic polypeptide
  source 1..2657: mol_type = other DNA
atgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccagtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaaggacccagggatggagcagtgtcctcactcattgcactcaccctacccaggatctgtaagtaataaatcttggaccttat

SEQ ID NO: 4857 - DNA, 443 bp, synthetic construct; identical to SEQ ID NO: 2837
  misc_feature 1..443: note = Synthetic polypeptide
  source 1..443: mol_type = other DNA

SEQ ID NO: 4858 - DNA, 720 bp, synthetic construct
  misc_feature 1..720: note = Synthetic polypeptide
  source 1..720: mol_type = other DNA
atggtgctgtgggagtccccgcggcagtgcagcagctggacactttgcgagggcttttgctggctgctgctgctgcccgtcatgctactcatcgtagcccgcccggtgaagctcgctgctttccctacctccttaagtgactgccaaacgcccaccggctggaattgctctggttatgatgacagagaaaatgatctcttcctctgtgacaccaacacctgtaaatttgatggggaatgtttaagaattggagacactgtgacttgcgtctgtcagttcaagtgcaacaatgactatgtgcctgtgtgtggctccaatggggagagctaccagaatgagtgttacctgcgacaggctgcatgcaaacagcagagtgagatacttgtggtgtcagaaggatcatgtgccacagatgcaggatcaggatctggagatggaggccggtgaggtggctcatgcctgtaatcccaacactttgggaggccgaggagggcagaccacttgaagtcaggagttcaagaccagcctggccaacatggtgaaaccctgctaatgaaaacacaaaaattagctctgcatggtggtgggtgcctgtaatcccagctactagggagaatcgcttgaacacggaaggcggaggttgcactgagccaagatcacgccactgtactccagcctgggtgacagagcaagaccctgtctcaaaaaaataaaaataaa

SEQ ID NO: 4859 - DNA, 1052 bp, synthetic construct; identical to SEQ ID NO: 247
  misc_feature 1..1052: note = Synthetic polypeptide
  source 1..1052: mol_type = other DNA

SEQ ID NO: 4860 - DNA, 327 bp, synthetic construct; identical to SEQ ID NO: 246
  misc_feature 1..327: note = Synthetic polypeptide
  source 1..327: mol_type = other DNA

SEQ ID NO: 4861 - DNA, 609 bp, synthetic construct; identical to SEQ ID NO: 249
  misc_feature 1..609: note = Synthetic polypeptide
  source 1..609: mol_type = other DNA

SEQ ID NO: 4862 - DNA, 738 bp, synthetic construct; identical to SEQ ID NO: 250
  misc_feature 1..738: note = Synthetic polypeptide
  source 1..738: mol_type = other DNA

SEQ ID NO: 4863 - DNA, 537 bp, synthetic construct; identical to SEQ ID NO: 251
  misc_feature 1..537: note = Synthetic polypeptide
  source 1..537: mol_type = other DNA

SEQ ID NO: 4864 - DNA, 684 bp, synthetic construct; identical to SEQ ID NO: 253
  misc_feature 1..684: note = Synthetic polypeptide
  source 1..684: mol_type = other DNA

SEQ ID NO: 4865 - DNA, 285 bp, synthetic construct; identical to SEQ ID NO: 255
  misc_feature 1..285: note = Synthetic polypeptide
  source 1..285: mol_type = other DNA

SEQ ID NO: 4866 - DNA, 552 bp, synthetic construct; identical to SEQ ID NO: 254
  misc_feature 1..552: note = Synthetic polypeptide
  source 1..552: mol_type = other DNA

SEQ ID NO: 4867 - DNA, 179 bp, synthetic construct
  misc_feature 1..179: note = Synthetic polypeptide
  source 1..179: mol_type = other DNA
atgtgggacctggttctctccatcgccttgtctgtggggtgcactgatgggaggggtggggcccaccctggaagagtggacagtgacacaaggtggacactctctacagatcactgaggataagctggagccacaatgcatgaggcacacacacagcaaggatgacgctgtaaacatag

SEQ ID NO: 4868 - DNA, 2100 bp, synthetic construct
  misc_feature 1..2100: note = Synthetic polypeptide
  source 1..2100: mol_type = other DNA
atgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacagatcgcagtggtcatgggctcctgcaccgcaggaggagcctatgtgcctgccatggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcatatagcccaagatttcttatgaatatggatgtgaaactattaacacaacatcacctaactgaatcaagcaccatatgaaaagggtgtatgtaaagaccaagttagatttacgcctacagtgaaaagttggcctaaaatgtaaaaatcacctagtgtaatatactatattaatcaaataaagatcagacacctgattatcacaatacatgcagaaaaaagtattggaaaaatccagtactcattcatgacaaactcccttaacaactctgagtacaatggaacttctgcaagctataaaagggcatatatgaatcactcatgcccagctccatccttagtcatgagtggctgagtgctttcctgtagatcagggacaagggaaggatgtctactttcacacttgaattcaacagtatactgctggtccttgcaagtatgagaacaaaacaaacaaaataaacaaacatgccaatcattcaaggcatccagcataggaaatattaaaatgtattcatttgtagatgacatgaacatctatgtagaaaatctgatagaatcaacaaaaaatatattagaactagtaggtattttagcaagattgcaggacatatgattagtataaacatatcaatcgtctttttatatattactaacaatctgaaaagaaaaacaagaacattgttacatttacaagagcctcaaaaataaataactaggaatagtttcttcttt

SEQ ID NO: 4869 - DNA, 1986 bp, synthetic construct
  misc_feature 1..1986: note = Synthetic polypeptide
  source 1..1986: mol_type = other DNA
atgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacaggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcatatagcccaagatttcttatgaatatggatgtgaaactattaacacaacatcacctaactgaatcaagcaccatatgaaaagggtgtatgtaaagaccaagttagatttacgcctacagtgaaaagttggcctaaaatgtaaaaatcacctagtgtaatatactatattaatcaaataaagatcagacacctgattatcacaatacatgcagaaaaaagtattggaaaaatccagtactcattcatgacaaactcccttaacaactctgagtacaatggaacttctgcaagctataaaagggcatatatgaatcactcatgcccagctccatccttagtcatgagtggctgagtgctttcctgtagatcagggacaagggaaggatgtctactttcacacttgaattcaacagtatactgctggtccttgcaagtatgagaacaaaacaaacaaaataaacaaacatgccaatcattcaaggcatccagcataggaaatattaaaatgtattcatttgtagatgacatgaacatctatgtagaaaatctgatagaatcaacaaaaaatatattagaactagtaggtattttagcaagattgcaggacatatgattagtataaacatatcaatcgtctttttatatattactaacaatctgaaaagaaaaacaagaacattgttacatttacaagagcctcaaaaataaataactaggaatagtttcttcttt

SEQ ID NO: 4870 - DNA, 1416 bp, synthetic construct
  misc_feature 1..1416: note = Synthetic polypeptide
  source 1..1416: mol_type = other DNA
atggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagagaaattcttcatgaaatattttctacggctagatcttaattcctataatagtacttggcaacatggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcatatagcccaagatttcttatgaatatggatgtgaaactattaacacaacatcacctaactgaatcaagcaccatatgaaaagggtgtatgtaaagaccaagttagatttacgcctacagtgaaaagttggcctaaaatgtaaaaatcacctagtgtaatatactatattaatcaaataaagatcagacacctgattatcacaatacatgcagaaaaaagtattggaaaaatccagtactcattcatgacaaactcccttaacaactctgagtacaatggaacttctgcaagctataaaagggcatatatgaatcactcatgcccagctccatccttagtcatgagtggctgagtgctttcctgtagatcagggacaagggaaggatgtctactttcacacttgaattcaacagtatactgctggtccttgcaagtatgagaacaaaacaaacaaaataaacaaacatgccaatcattcaaggcatccagcataggaaatattaaaatgtattcatttgtagatgacatgaacatctatgtagaaaatctgatagaatcaacaaaaaatatattagaactagtaggtattttagcaagattgcaggacatatgattagtataaacatatcaatcgtctttttatatattactaacaatctgaaaagaaaaacaagaacattgttacatttacaagagcctcaaaaataaataactaggaatagtttcttcttt

SEQ ID NO: 4871 - DNA, 137 bp, synthetic construct; identical to SEQ ID NO: 336
  misc_feature 1..137: note = Synthetic polypeptide
  source 1..137: mol_type = other DNA

SEQ ID NO: 4872 - DNA, 1230 bp, synthetic construct
  misc_feature 1..1230: note = Synthetic polypeptide
  source 1..1230: mol_type = other DNA
atggccagcactattaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggttggacccaatgatctgcttttaatgaatagaatatagcagatgtgacagtgtgtgacttctgggactgggtcatagaaggcagcgtggccttctctttgcatcacttattctgggggaagagactgccatgtcatgaagacttgcagccctacagagaagtgtatgggatgaggaaatgaagcctcctgtcaaaagccaattctccagccccagtcaagccttcgtgtaacctcagtcttggtcaacatcttaactgaaacctcatgagagaccctgagccaccagccacccacgtgagctgcttctgaatgcctgatccaccaaaactgtgagataataaatgtttatggagaaatttgttacacagcaataaatagtta

SEQ ID NO: 4873 - DNA, 1233 bp, synthetic construct
  misc_feature 1..1233: note = Synthetic polypeptide
  source 1..1233: mol_type = other DNA
atggccagcactattaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagggggtgcagcttttattttcccaaatacttcagtatatcctgaagctacgcaaagaattacaactaggccagctgctcaaccatctccttccacagtgcccaaaactgaagaccagcgtcctcagttagatccttatcagattcttggaccaacaagtagccgccttgcaaatccaggttggacccaatgatctgcttttaatgaatagaatatagcagatgtgacagtgtgtgacttctgggactgggtcatagaaggcagcgtggccttctctttgcatcacttattctgggggaagagactgccatgtcatgaagacttgcagccctacagagaagtgtatgggatgaggaaatgaagcctcctgtcaaaagccaattctccagccccagtcaagccttcgtgtaacctcagtcttggtcaacatcttaactgaaacctcatgagagaccctgagccaccagccacccacgtgagctgcttctgaatgcctgatccaccaaaactgtgagataataaatgtttatggagaaatttgttacacagcaataaatagtta

SEQ ID NO: 4874 - DNA, 1302 bp, synthetic construct
  misc_feature 1..1302: note = Synthetic polypeptide
  source 1..1302: mol_type = other DNA
atggccagcactattaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagggggtgcagcttttattttcccaaatacttcagtatatcctgaagctacgcaaagaattacaactaggccagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggttggacccaatgatctgcttttaatgaatagaatatagcagatgtgacagtgtgtgacttctgggactgggtcatagaaggcagcgtggccttctctttgcatcacttattctgggggaagagactgccatgtcatgaagacttgcagccctacagagaagtgtatgggatgaggaaatgaagcctcctgtcaaaagccaattctccagccccagtcaagccttcgtgtaacctcagtcttggtcaacatcttaactgaaacctcatgagagaccctgagccaccagccacccacgtgagctgcttctgaatgcctgatccaccaaaactgtgagataataaatgtttatggagaaatttgttacacagcaataaatagtta

SEQ ID NO: 4875 - DNA, 954 bp, synthetic construct
  misc_feature 1..954: note = Synthetic polypeptide
  source 1..954: mol_type = other DNA
atggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggttggacccaatgatctgcttttaatgaatagaatatagcagatgtgacagtgtgtgacttctgggactgggtcatagaaggcagcgtggccttctctttgcatcacttattctgggggaagagactgccatgtcatgaagacttgcagccctacagagaagtgtatgggatgaggaaatgaagcctcctgtcaaaagccaattctccagccccagtcaagccttcgtgtaacctcagtcttggtcaacatcttaactgaaacctcatgagagaccctgagccaccagccacccacgtgagctgcttctgaatgcctgatccaccaaaactgtgagataataaatgtttatggagaaatttgttacacagcaataaatagtta

SEQ ID NO: 4876 - DNA, 1251 bp, synthetic construct
  misc_feature 1..1251: note = Synthetic polypeptide
  source 1..1251: mol_type = other DNA
atgattcagactgtcccggacccagcagctcatatcaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggttggacccaatgatctgcttttaatgaatagaatatagcagatgtgacagtgtgtgacttctgggactgggtcatagaaggcagcgtggccttctctttgcatcacttattctgggggaagagactgccatgtcatgaagacttgcagccctacagagaagtgtatgggatgaggaaatgaagcctcctgtcaaaagccaattctccagccccagtcaagccttcgtgtaacctcagtcttggtcaacatcttaactgaaacctcatgagagaccctgagccaccagccacccacgtgagctgcttctgaatgcctgatccaccaaaactgtgagataataaatgtttatggagaaatttgttacacagcaataaatagtta

SEQ ID NO: 4877 - DNA, 1254 bp, synthetic construct
  misc_feature 1..1254: note = Synthetic polypeptide
  source 1..1254: mol_type = other DNA
atgattcagactgtcccggacccagcagctcatatcaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagggggtgcagcttttattttcccaaatacttcagtatatcctgaagctacgcaaagaattacaactaggccagctgctcaaccatctccttccacagtgcccaaaactgaagaccagcgtcctcagttagatccttatcagattcttggaccaacaagtagccgccttgcaaatccaggttggacccaatgatctgcttttaatgaatagaatatagcagatgtgacagtgtgtgacttctgggactgggtcatagaaggcagcgtggccttctctttgcatcacttattctgggggaagagactgccatgtcatgaagacttgcagccctacagagaagtgtatgggatgaggaaatgaagcctcctgtcaaaagccaattctccagccccagtcaagccttcgtgtaacctcagtcttggtcaacatcttaactgaaacctcatgagagaccctgagccaccagccacccacgtgagctgcttctgaatgcctgatccaccaaaactgtgagataataaatgtttatggagaaatttgttacacagcaataaatagtta

SEQ ID NO: 4878 - DNA, 1323 bp, synthetic construct
  misc_feature 1..1323: note = Synthetic polypeptide
  source 1..1323: mol_type = other DNA
atgattcagactgtcccggacccagcagctcatatcaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagggggtgcagcttttattttcccaaatacttcagtatatcctgaagctacgcaaagaattacaactaggccagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggttggacccaatgatctgcttttaatgaatagaatatagcagatgtgacagtgtgtgacttctgggactgggtcatagaaggcagcgtggccttctctttgcatcacttattctgggggaagagactgccatgtcatgaagacttgcagccctacagagaagtgtatgggatgaggaaatgaagcctcctgtcaaaagccaattctccagccccagtcaagccttcgtgtaacctcagtcttggtcaacatcttaactgaaacctcatgagagaccctgagccaccagccacccacgtgagctgcttctgaatgcctgatccaccaaaactgtgagataataaatgtttatggagaaatttgttacacagcaataaatagtta

SEQ ID NO: 4879 - DNA, 1026 bp, synthetic construct
  misc_feature 1..1026: note = Synthetic polypeptide
  source 1..1026: mol_type = other DNA
atggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagggggtgcagcttttattttcccaaatacttcagtatatcctgaagctacgcaaagaattacaactaggccagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggttggacccaatgatctgcttttaatgaatagaatatagcagatgtgacagtgtgtgacttctgggactgggtcatagaaggcagcgtggccttctctttgcatcacttattctgggggaagagactgccatgtcatgaagacttgcagccctacagagaagtgtatgggatgaggaaatgaagcctcctgtcaaaagccaattctccagccccagtcaagccttcgtgtaacctcagtcttggtcaacatcttaactgaaacctcatgagagaccctgagccaccagccacccacgtgagctgcttctgaatgcctgatccaccaaaactgtgagataataaatgtttatggagaaatttgttacacagcaataaatagtta

SEQ ID NO: 4880 - DNA, 8447 bp, synthetic construct
  misc_feature 1..8447: note = Synthetic polypeptide
  source 1..8447: mol_type = other DNA
atggagaaggatgctgaagatggcgccccttctgagggagcagaggctcctccctctacggaagaggctgcccctccccgttcagaagaggaagaggccccgcgccctccgacagtggaggccccggcagaagatggtttctctccttccgcagaagatgctgtttcttctgtggtggattatcgggatctcattccttctgaagaagggatagttcttccagatgatcatgaagcggatctgaatagagttcgacagaggcttgcaccgcgaccggttcagtcagtgatttcggaagtgctgtccttgccgtcttcccggaggtcctccagataccgccggagtatgagtggccttcccaatctacaggaaacattaaaagagagacaggcaagatttagagaggcaagggaaagccgaagactgaaaattgacccttcatacaaatatatatttgaaattctagcagaaaatcttggcctggacatagtaactgttgaagaattaattttggattgcccatctctggaagcatttactaatttttttgcgaaagatggttgtaagacactgaaatttttgtaccaagaaggagatgtacctggtattgaatgtggtcgaactattgctggagcaactaaaggggcaaaaatgatgaaattgtatatagacaatgcagccccggataaactaaaaggactgtgcatattttttgttcgttgccgtaatgatgttgctataaatgttaaaactattcaagaggaagcgctctttactgttctggatgcgtcgaaaggactcttaaatggaattagggatatgttggcaaatatatttctaccagctgttcttgcaacaaacaactggggtgctttaaaccagtccaagcagggagaatctgaaaaacatattttcactgaaaccatcaacagatatctttcatttttagatggtgctagaataagtattgagggaacagtgaagttaaagacaatagacaatgttaatttttccaaactgcacacctttgaagaagtaactgctgcagccagcaactcagaaactgttcatcagctggaggaagtgctgatggtatggtacaaacagatcgaacaggtacttattgagagtgagcagatgagaaaagaagctggtgattcaggtccactcactgaattggaacactggaaacgcatgtcagccaagttcaactatatcattgagcagattaaagggccaagttgtaaggctgtcataaatgtgctaaatgttgcacactccaaactgctaaagaattggcgtgatttggatgcaagaatcactgatacagcaaatgaatccaaagataatgtcagatatttgtatactttggaaaaagtgtgtcaacctctctataaccatgacctagtttccatggcacatggaatacaaaatttgattaatgccatcagaatgattcacggtgtgtcaaggtattataatacctcagagagaatgacctcattgtttatcaaggtaacaaatcaaatggtaacagcatgtaaagcatatattactgatggaggattaaaccatgtatgggatcaggaaacgccagttgtactaaagaaaattcaggactgcatttttctattcaaggaatatcaggcatcttttcataaaacaaggaaactgatttcagaatcctcaggggaaaaatcttttgaggtttcagaaatgtatatatttggaaaatttgaagctttttgcaaaagactggagaagattacagaaatgataactgttgtgcaaacatattcaaccttgagtaattctaccatagaaggaatagatattatggcaataaaattcagaaatatataccaaggggttaagaaaaagcaatatgacattctggatccaagaaggacagaatttgacacagatttcttagatttcatgacaaaaatcaatggtttagaggtacaaatacaggcatttatgaacagtagttttgggaaaatcttatcttctcagcaggctcttcagctacttcaaaggtttcagaagctgaacattccctgtctgggattagaaataaaccacacaatagagcgtattcttcagtactatgtggctgaacttgatgctactaagaagctttatcattctcagaaagatgacccccctcttgctcgcaacatgccccctatagcaggaaaaatactctgggtgaggcagctctatcgccggataagtgagcccatcaattatttctttaaaaactcagacattttatcaagtccggacggtaaagctgtcatccgtcagtataacaagatctcctatgtgctggtggaattcgaggtggtctatcacacagcctggatcagagagatttcacagttgcattacgctttacaagccacgctttttgtgcgacatccagaaacagggaagttgctggttaatttcgatcccaaaattttggaagttgttcgggaaactaagtgtatgataaaaatgaagttggatgtaccagaacaggcaaagagattgctaaaattggaaagtaaattgaaagcagacaaactgtatttgcagggtcttctgcaatattatgatgagttatgtcaggaagtgccttctgtgtttgtcaatctgatgaccccaaaaatgaaaaaggtggaatctgtgttgaggcaaggactcacagtgttaacatggtcgtctttaacactggaaagcttctttcaagaagtcgaattagttttggatatgttcaatcaacttttaaagaagatcagtgacttgtgtgaaatgcatattgatacagttctgaaggagatagccaaaactgtgttgatttctctgcctgaaagtggtgctaccaaagtagaagatatgttgaccctcaatgagacatacacaaaagaatgggctgacattctaaaccacaaaagtaagcatgtggaagaagctgtcagagaacttatatcaatatttgagcagatttatgaagtgaaatacactgggaaagtaggaaaacagtcagaacagcggaaacacgttgtttttggaagtgaaacaggagagggtgaaaacaatgactatgaagctaatattgtgaatgagtttgatactcatgataaagaagatgaatttaaaaaggagtgtaaagaggtctttgcttttttctctcatcaattactagacagtcttcaaaaagctacacggttatctctggacacaatgaaaagaagaatatttgttgcaagcctttatgggcgaaagcagtcagaagatattatttcctttataaaaagtgaagtacatcttgcaattcctaatgtggtgatgattcctagtttggatgacattcaacaagccattaaccgtatgatccagttaaccctggaggtcagcagaggagtggctcactgggggcaacagcaaatccgtcccatcaagtctgtcattcccagccccaccactactgacgtgacccatcaaaacacaggaaaactgctgaagaaggaagaaagatcttttgaagaagctattcctgcgaggaagctgaagaatttttacccgggggtagcggagcacaaggatatttctaagttggtcctgctcctttcttcctctgtaaattccctaagaaaggcagctcatgaggccctgcaggactttcagaagtacaagactctctggacagaggaccgcgatgtgaaagtgaaggaatttttggctaacaacccctctctgactgaaatcagatcagaaattctacactatgctacttttgaacaggagattgatgagttgaagcctattattgttgtaggagcacttgaattacatacagagccgatgaaattggccttatccatcgaggccaaggcatggaagatgttactctgtcgatatctgaatgaagaatacaaaaagaaaatgtcatacatgatagcatttattaatgaatacttgaaaaagttatctagacctattcgtgatttagatgatgtcagatttgcaatggaagccttgtcttgcatacgtgataatgaaattcaaatggacatgactttgggaccaattgaagaagcctatgctattttaaacagatttgaagttgaagtaaccaaagaagaatcagaagcagttgataccttaagatattctttcaacaaattgcagagcaaagctgtttcagtacaagaggacctagttcaagtgcagccaaagtttaaaagcaatctacttgagtctgtggaagtttttcgtgaggacgtgataaactttgcagaagcatatgaattggaaggacctatggttccaaatataccaccccaagaagctagcaacaggctacagatatttcaggccagtttcgatgatctgtggaggaaatttgttacgtattcatctggtgaacaactttttggattgcctgtgactgattatgaggttttacacaaaaccagaaaagaactcaacttgctgcagaagctgtatggattgtatgacaccgtaatgagcagtattagtggttattatgaaatactttggggagatgtagatattgaaaaaattaatgcagaactgctggaatttcaaaacagatgtcgtaaacttccaaaaggacttaaagattggcaagcttttttggatctcaaaaagagaattgatgatttcagtgagtcatgtcctctactggaaatgatgaccaataaggccatgaaacagagacactgggatagaatctccgagttaactggaaccccatttgatgtggaatctgattctttttgccttagaaatatcatggaagcaccactccttaaacataaggatgatattgaggatatttgcatatctgccattaaggagaaggatatcgaagccaagctgactcaggtgattgagaattggaccaaccaaaatctgagttttgcagcatttaagggaaaaggagagctcctgctcaaaggaaccgaatcgggagaaattatcactttgatggaggatagtttaatggtcttagggtctttactcagcaacagatacaatgctccatttaaaaaaaatatccagaattgggtgtataaattgtccacttcctcagatataattgaagagtggctcgtagtacagaacctttgggtttatcttgaagccgtctttgtaggtggagatattgccaaacagctgcctcaggaagcaaaacgttttcagaatattgacaagtcttggataaaaataatgcagcgagctcatgagaatcccaatgtgattaattgctgtgttggagatgaaaccatgggacaacttttacctcatttacatgagcagttggaagtatgtcagaagtcactcacagggtatttggagaagaaacgattactgtttccaagattcttctttgtatctgatccagttctcctggaaattcttggacaagccagtgattcccacaccatacagccgcatctccctgcagtatctgacaacatcaatgaggtgacatttcatgcaaaagactatgatcgcatcatggccgtcatatcaagagaaggagaaaaaattgttttggataattctgttatggccaaaggtcctgtggagatttggctactggatttgttaaaaatgcagatgtcatcattacataatataattagatccgctttctatcaaatcagtgattcaggatttcaactcttaccattcctcagccactttccagcacaggttggacttctgggaattcagatgttgtggacacacgattcagaagaggctttacgtaatgcaaaagatgacaggaaaatcatgcaagtgaccaatcagaaatttttggatattctaaatactctcattagtcagacaacacatgatctaagcaagtttgatagagtgaagttcgagactctaattaccatccatgtgcatcagagagatatttttgatgacttggtaaaaatgcatatcaaatcacctactgactttgaatggctaaaacagagtagattttattttaaggaagatttggatcaaactgtggtgtctattacagatgttgattttatttaccaaaatgaatttctgggatgtactgatcgtcttgttatcactccattaacagatagatgctatatcacgttagctcaggccttgggcatgaacatgggaggtgctcccgcaggacctgctggcactggcaaaacagaaaccacaaaagacatgggaaggtgtttgggaaaatatgtggtcgtgttcaattgctcagatcaaatggatttcagaggcctaggaaggattttcaaaggtcttgcacagtcgggttcctggggctgttttgatgagtttaacagaattgaattgcctgtattatcagtggcagcacaacaaatttatattgttttgacagcaagaaaagaaagaaagaaacagttcattttttctgatggtgattgtgttgatttaaatccagaatttggaatcttcttaacgatgaaccctggatatgctgggcgccaggaactaccagaaaacctaaaaatccagtttagaactgttgctatgatggttcctgatagacagatcattatgagagttaaacttgcaagctgtggttttcttgaaaatgttatcttggctcaaaaattttacgttctttacaaactctgtgaagagcaacttactaaacaggttcattatgactttggattgagaaatattctgtctgtattgaggactcttggatctcaaaaaagagccagaccagaagatagtgaattaagcattgtcatgagaggactaagagatatgaacctttccaaactggttgatgaagatgaacccctgttcctcagcttaatcaatgacctgttcccaggactgcaactggatagtaatacttatgcagaactgcaaaacgcagtagcccatcaggttcagatagagggtttgattaaccatccaccctggaacctgaaactcgtgcagttatatgagacgtctttggtacggcatggcttgatgactcttgggcccagtggttctggaaagacaaccgttatcacgattctaatgaaggcgcaaacagaatgcggaaggcctcatagagaaatgcgaatgaatccaaaagccattactgcacctcagatgtttggcagactggacactgctaccaatgactggacagatgggattttttctactctgtggagaaaaacattaaaagctaaaaaaggtgaaaacattttcctcattttagatggtcctgtggatgccatctggattgagaacttaaattccgttttggatgacaataaaactctgacgttagctaatggagatcgcattcccatggcccctagttgtaagcttctgtttgaagtccacaatatcgagaacgcctctcctgccacggtttctaggatgggcatggtctatatcagcagctctgctctcagctggaggccaatcttacaggcatggttgaagaaacgcactgcacaggaagctgctgtattcctgacactgtatgagaaagtctttgaagatacatacacatatatgaagctaaatctcaatcccaaaatgcagctcttggagtgcaactatattgtgcaatctctcaatcttctggaagggttaattccctccaaagaagaaggcggtgtttcctgtgtcgaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatgtatgagttttatgttactgattatggtgattgggagcactggaataagaaacttcagccttattattatccaactgacagtattccggaatattcatcaattttggttccaaatgttgacaatattagaacaaattttttgatagacaccattgcaaaacaacataaagctgttttgctcacaggagagcagggaactgcaaaaactgtcatggttaaggcctatttgaaaaaatatgatcctgaagtacagctatccaaaagtctaaacttttcatctgccacagaaccaatgatgtttcagagaacaattgaaagctacgtggataagcgaattggaagcacatatgggccaccaggagggagaaaaatgactgtatttattgatgatattaatatgcctgtgattaatgagtggggagatcaggtcattccccattagaagacttcaccggtgttgccagaagtccgcatgctcctggtgggatccccaacactttcctcccaccgacctacactgcttcattgacaccatctactttggctctaccaggacaagtcccattttgctctttatccctattcgcctcagacaccactagaagctcagtactc

SEQ ID NO: 4881 - DNA, 8411 bp, synthetic construct
  misc_feature 1..8411: note = Synthetic polypeptide
  source 1..8411: mol_type = other DNA
ggagcagaggctcctccctctacggaagaggctgcccctccccgttcagaagaggaagaggccccgcgccctccgacagtggaggccccggcagaagatggtttctctccttccgcagaagatgctgtttcttctgtggtggattatcgggatctcattccttctgaagaagggatagttcttccagatgatcatgaagcggatctgaatagagttcgacagaggcttgcaccgcgaccggttcagtcagtgatttcggaagtgctgtccttgccgtcttcccggaggtcctccagataccgccggagtatgagtggccttcccaatctacaggaaacattaaaagagagacaggcaagatttagagaggcaagggaaagccgaagactgaaaattgacccttcatacaaatatatatttgaaattctagcagaaaatcttggcctggacatagtaactgttgaagaattaattttggattgcccatctctggaagcatttactaatttttttgcgaaagatggttgtaagacactgaaatttttgtaccaagaaggagatgtacctggtattgaatgtggtcgaactattgctggagcaactaaaggggcaaaaatgatgaaattgtatatagacaatgcagccccggataaactaaaaggactgtgcatattttttgttcgttgccgtaatgatgttgctataaatgttaaaactattcaagaggaagcgctctttactgttctggatgcgtcgaaaggactcttaaatggaattagggatatgttggcaaatatatttctaccagctgttcttgcaacaaacaactggggtgctttaaaccagtccaagcagggagaatctgaaaaacatattttcactgaaaccatcaacagatatctttcatttttagatggtgctagaataagtattgagggaacagtgaagttaaagacaatagacaatgttaatttttccaaactgcacacctttgaagaagtaactgctgcagccagcaactcagaaactgttcatcagctggaggaagtgctgatggtatggtacaaacagatcgaacaggtacttattgagagtgagcagatgagaaaagaagctggtgattcaggtccactcactgaattggaacactggaaacgcatgtcagccaagttcaactatatcattgagcagattaaagggccaagttgtaaggctgtcataaatgtgctaaatgttgcacactccaaactgctaaagaattggcgtgatttggatgcaagaatcactgatacagcaaatgaatccaaagataatgtcagatatttgtatactttggaaaaagtgtgtcaacctctctataaccatgacctagtttccatggcacatggaatacaaaatttgattaatgccatcagaatgattcacggtgtgtcaaggtattataatacctcagagagaatgacctcattgtttatcaaggtaacaaatcaaatggtaacagcatgtaaagcatatattactgatggaggattaaaccatgtatgggatcaggaaacgccagttgtactaaagaaaattcaggactgcatttttctattcaaggaatatcaggcatcttttcataaaacaaggaaactgatttcagaatcctcaggggaaaaatcttttgaggtttcagaaatgtatatatttggaaaatttgaagctttttgcaaaagactggagaagattacagaaatgataactgttgtgcaaacatattcaaccttgagtaattctaccatagaaggaatagatattatggcaataaaattcagaaatatataccaaggggttaagaaaaagcaatatgacattctggatccaagaaggacagaatttgacacagatttcttagatttcatgacaaaaatcaatggtttagaggtacaaatacaggcatttatgaacagtagttttgggaaaatcttatcttctcagcaggctcttcagctacttcaaaggtttcagaagctgaacattccctgtctgggattagaaataaaccacacaatagagcgtattcttcagtactatgtggctgaacttgatgctactaagaagctttatcattctcagaaagatgacccccctcttgctcgcaacatgccccctatagcaggaaaaatactctgggtgaggcagctctatcgccggataagtgagcccatcaattatttctttaaaaactcagacattttatcaagtccggacggtaaagctgtcatccgtcagtataacaagatctcctatgtgctggtggaattcgaggtggtctatcacacagcctggatcagagagatttcacagttgcattacgctttacaagccacgctttttgtgcgacatccagaaacagggaagttgctggttaatttcgatcccaaaattttggaagttgttcgggaaactaagtgtatgataaaaatgaagttggatgtaccagaacaggcaaagagattgctaaaattggaaagtaaattgaaagcagacaaactgtatttgcagggtcttctgcaatattatgatgagttatgtcaggaagtgccttctgtgtttgtcaatctgatgaccccaaaaatgaaaaaggtggaatctgtgttgaggcaaggactcacagtgttaacatggtcgtctttaacactggaaagcttctttcaagaagtcgaattagttttggatatgttcaatcaacttttaaagaagatcagtgacttgtgtgaaatgcatattgatacagttctgaaggagatagccaaaactgtgttgatttctctgcctgaaagtggtgctaccaaagtagaagatatgttgaccctcaatgagacatacacaaaagaatgggctgacattctaaaccacaaaagtaagcatgtggaagaagctgtcagagaacttatatcaatatttgagcagatttatgaagtgaaatacactgggaaagtaggaaaacagtcagaacagcggaaacacgttgtttttggaagtgaaacaggagagggtgaaaacaatgactatgaagctaatattgtgaatgagtttgatactcatgataaagaagatgaatttaaaaaggagtgtaaagaggtctttgcttttttctctcatcaattactagacagtcttcaaaaagctacacggttatctctggacacaatgaaaagaagaatatttgttgcaagcctttatgggcgaaagcagtcagaagatattatttcctttataaaaagtgaagtacatcttgcaattcctaatgtggtgatgattcctagtttggatgacattcaacaagccattaaccgtatgatccagttaaccctggaggtcagcagaggagtggctcactgggggcaacagcaaatccgtcccatcaagtctgtcattcccagccccaccactactgacgtgacccatcaaaacacaggaaaactgctgaagaaggaagaaagatcttttgaagaagctattcctgcgaggaagctgaagaatttttacccgggggtagcggagcacaaggatatttctaagttggtcctgctcctttcttcctctgtaaattccctaagaaaggcagctcatgaggccctgcaggactttcagaagtacaagactctctggacagaggaccgcgatgtgaaagtgaaggaatttttggctaacaacccctctctgactgaaatcagatcagaaattctacactatgctacttttgaacaggagattgatgagttgaagcctattattgttgtaggagcacttgaattacatacagagccgatgaaattggccttatccatcgaggccaaggcatggaagatgttactctgtcgatatctgaatgaagaatacaaaaagaaaatgtcatacatgatagcatttattaatgaatacttgaaaaagttatctagacctattcgtgatttagatgatgtcagatttgcaatggaagccttgtcttgcatacgtgataatgaaattcaaatggacatgactttgggaccaattgaagaagcctatgctattttaaacagatttgaagttgaagtaaccaaagaagaatcagaagcagttgataccttaagatattctttcaacaaattgcagagcaaagctgtttcagtacaagaggacctagttcaagtgcagccaaagtttaaaagcaatctacttgagtctgtggaagtttttcgtgaggacgtgataaactttgcagaagcatatgaattggaaggacctatggttccaaatataccaccccaagaagctagcaacaggctacagatatttcaggccagtttcgatgatctgtggaggaaatttgttacgtattcatctggtgaacaactttttggattgcctgtgactgattatgaggttttacacaaaaccagaaaagaactcaacttgctgcagaagctgtatggattgtatgacaccgtaatgagcagtattagtggttattatgaaatactttggggagatgtagatattgaaaaaattaatgcagaactgctggaatttcaaaacagatgtcgtaaacttccaaaaggacttaaagattggcaagcttttttggatctcaaaaagagaattgatgatttcagtgagtcatgtcctctactggaaatgatgaccaataaggccatgaaacagagacactgggatagaatctccgagttaactggaaccccatttgatgtggaatctgattctttttgccttagaaatatcatggaagcaccactccttaaacataaggatgatattgaggatatttgcatatctgccattaaggagaaggatatcgaagccaagctgactcaggtgattgagaattggaccaaccaaaatctgagttttgcagcatttaagggaaaaggagagctcctgctcaaaggaaccgaatcgggagaaattatcactttgatggaggatagtttaatggtcttagggtctttactcagcaacagatacaatgctccatttaaaaaaaatatccagaattgggtgtataaattgtccacttcctcagatataattgaagagtggctcgtagtacagaacctttgggtttatcttgaagccgtctttgtaggtggagatattgccaaacagctgcctcaggaagcaaaacgttttcagaatattgacaagtcttggataaaaataatgcagcgagctcatgagaatcccaatgtgattaattgctgtgttggagatgaaaccatgggacaacttttacctcatttacatgagcagttggaagtatgtcagaagtcactcacagggtatttggagaagaaacgattactgtttccaagattcttctttgtatctgatccagttctcctggaaattcttggacaagccagtgattcccacaccatacagccgcatctccctgcagtatctgacaacatcaatgaggtgacatttcatgcaaaagactatgatcgcatcatggccgtcatatcaagagaaggagaaaaaattgttttggataattctgttatggccaaaggtcctgtggagatttggctactggatttgttaaaaatgcagatgtcatcattacataatataattagatccgctttctatcaaatcagtgattcaggatttcaactcttaccattcctcagccactttccagcacaggttggacttctgggaattcagatgttgtggacacacgattcagaagaggctttacgtaatgcaaaagatgacaggaaaatcatgcaagtgaccaatcagaaatttttggatattctaaatactctcattagtcagacaacacatgatctaagcaagtttgatagagtgaagttcgagactctaattaccatccatgtgcatcagagagatatttttgatgacttggtaaaaatgcatatcaaatcacctactgactttgaatggctaaaacagagtagattttattttaaggaagatttggatcaaactgtggtgtctattacagatgttgattttatttaccaaaatgaatttctgggatgtactgatcgtcttgttatcactccattaacagatagatgctatatcacgttagctcaggccttgggcatgaacatgggaggtgctcccgcaggacctgctggcactggcaaaacagaaaccacaaaagacatgggaaggtgtttgggaaaatatgtggtcgtgttcaattgctcagatcaaatggatttcagaggcctaggaaggattttcaaaggtcttgcacagtcgggttcctggggctgttttgatgagtttaacagaattgaattgcctgtattatcagtggcagcacaacaaatttatattgttttgacagcaagaaaagaaagaaagaaacagttcattttttctgatggtgattgtgttgatttaaatccagaatttggaatcttcttaacgatgaaccctggatatgctgggcgccaggaactaccagaaaacctaaaaatccagtttagaactgttgctatgatggttcctgatagacagatcattatgagagttaaacttgcaagctgtggttttcttgaaaatgttatcttggctcaaaaattttacgttctttacaaactctgtgaagagcaacttactaaacaggttcattatgactttggattgagaaatattctgtctgtattgaggactcttggatctcaaaaaagagccagaccagaagatagtgaattaagcattgtcatgagaggactaagagatatgaacctttccaaactggttgatgaagatgaacccctgttcctcagcttaatcaatgacctgttcccaggactgcaactggatagtaatacttatgcagaactgcaaaacgcagtagcccatcaggttcagatagagggtttgattaaccatccaccctggaacctgaaactcgtgcagttatatgagacgtctttggtacggcatggcttgatgactcttgggcccagtggttctggaaagacaaccgttatcacgattctaatgaaggcgcaaacagaatgcggaaggcctcatagagaaatgcgaatgaatccaaaagccattactgcacctcagatgtttggcagactggacactgctaccaatgactggacagatgggattttttctactctgtggagaaaaacattaaaagctaaaaaaggtgaaaacattttcctcattttagatggtcctgtggatgccatctggattgagaacttaaattccgttttggatgacaataaaactctgacgttagctaatggagatcgcattcccatggcccctagttgtaagcttctgtttgaagtccacaatatcgagaacgcctctcctgccacggtttctaggatgggcatggtctatatcagcagctctgctctcagctggaggccaatcttacaggcatggttgaagaaacgcactgcacaggaagctgctgtattcctgacactgtatgagaaagtctttgaagatacatacacatatatgaagctaaatctcaatcccaaaatgcagctcttggagtgcaactatattgtgcaatctctcaatcttctggaagggttaattccctccaaagaagaaggcggtgtttcctgtgtcgaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatgtatgagttttatgttactgattatggtgattgggagcactggaataagaaacttcagccttattattatccaactgacagtattccggaatattcatcaattttggttccaaatgttgacaatattagaacaaattttttgatagacaccattgcaaaacaacataaagctgttttgctcacaggagagcagggaactgcaaaaactgtcatggttaaggcctatttgaaaaaatatgatcctgaagtacagctatccaaaagtctaaacttttcatctgccacagaaccaatgatgtttcagagaacaattgaaagctacgtggataagcgaattggaagcacatatgggccaccaggagggagaaaaatgactgtatttattgatgatattaatatgcctgtgattaatgagtggggagatcaggtcattccccattagaagacttcaccggtgttgccagaagtccgcatgctcctggtgggatccccaacactttcctcccaccgacctacactgcttcattgacaccatctactttggctctaccaggacaagtcccattttgctctttatccctattcgcctcagacaccactagaagctcagtactc

SEQ ID NO: 4882 - DNA, 7796 bp, synthetic construct
  misc_feature 1..7796: note = Synthetic polypeptide
  source 1..7796: mol_type = other DNA
atgatgaaattgtatatagacaatgcagccccggataaactaaaaggactgtgcatattttttgttcgttgccgtaatgatgttgctataaatgttaaaactattcaagaggaagcgctctttactgttctggatgcgtcgaaaggactcttaaatggaattagggatatgttggcaaatatatttctaccagctgttcttgcaacaaacaactggggtgctttaaaccagtccaagcagggagaatctgaaaaacatattttcactgaaaccatcaacagatatctttcatttttagatggtgctagaataagtattgagggaacagtgaagttaaagacaatagacaatgttaatttttccaaactgcacacctttgaagaagtaactgctgcagccagcaactcagaaactgttcatcagctggaggaagtgctgatggtatggtacaaacagatcgaacaggtacttattgagagtgagcagatgagaaaagaagctggtgattcaggtccactcactgaattggaacactggaaacgcatgtcagccaagttcaactatatcattgagcagattaaagggccaagttgtaaggctgtcataaatgtgctaaatgttgcacactccaaactgctaaagaattggcgtgatttggatgcaagaatcactgatacagcaaatgaatccaaagataatgtcagatatttgtatactttggaaaaagtgtgtcaacctctctataaccatgacctagtttccatggcacatggaatacaaaatttgattaatgccatcagaatgattcacggtgtgtcaaggtattataatacctcagagagaatgacctcattgtttatcaaggtaacaaatcaaatggtaacagcatgtaaagcatatattactgatggaggattaaaccatgtatgggatcaggaaacgccagttgtactaaagaaaattcaggactgcatttttctattcaaggaatatcaggcatcttttcataaaacaaggaaactgatttcagaatcctcaggggaaaaatcttttgaggtttcagaaatgtatatatttggaaaatttgaagctttttgcaaaagactggagaagattacagaaatgataactgttgtgcaaacatattcaaccttgagtaattctaccatagaaggaatagatattatggcaataaaattcagaaatatataccaaggggttaagaaaaagcaatatgacattctggatccaagaaggacagaatttgacacagatttcttagatttcatgacaaaaatcaatggtttagaggtacaaatacaggcatttatgaacagtagttttgggaaaatcttatcttctcagcaggctcttcagctacttcaaaggtttcagaagctgaacattccctgtctgggattagaaataaaccacacaatagagcgtattcttcagtactatgtggctgaacttgatgctactaagaagctttatcattctcagaaagatgacccccctcttgctcgcaacatgccccctatagcaggaaaaatactctgggtgaggcagctctatcgccggataagtgagcccatcaattatttctttaaaaactcagacattttatcaagtccggacggtaaagctgtcatccgtcagtataacaagatctcctatgtgctggtggaattcgaggtggtctatcacacagcctggatcagagagatttcacagttgcattacgctttacaagccacgctttttgtgcgacatccagaaacagggaagttgctggttaatttcgatcccaaaattttggaagttgttcgggaaactaagtgtatgataaaaatgaagttggatgtaccagaacaggcaaagagattgctaaaattggaaagtaaattgaaagcagacaaactgtatttgcagggtcttctgcaatattatgatgagttatgtcaggaagtgccttctgtgtttgtcaatctgatgaccccaaaaatgaaaaaggtggaatctgtgttgaggcaaggactcacagtgttaacatggtcgtctttaacactggaaagcttctttcaagaagtcgaattagttttggatatgttcaatcaacttttaaagaagatcagtgacttgtgtgaaatgcatattgatacagttctgaaggagatagccaaaactgtgttgatttctctgcctgaaagtggtgctaccaaagtagaagatatgttgaccctcaatgagacatacacaaaagaatgggctgacattctaaaccacaaaagtaagcatgtggaagaagctgtcagagaacttatatcaatatttgagcagatttatgaagtgaaatacactgggaaagtaggaaaacagtcagaacagcggaaacacgttgtttttggaagtgaaacaggagagggtgaaaacaatgactatgaagctaatattgtgaatgagtttgatactcatgataaagaagatgaatttaaaaaggagtgtaaagaggtctttgcttttttctctcatcaattactagacagtcttcaaaaagctacacggttatctctggacacaatgaaaagaagaatatttgttgcaagcctttatgggcgaaagcagtcagaagatattatttcctttataaaaagtgaagtacatcttgcaattcctaatgtggtgatgattcctagtttggatgacattcaacaagccattaaccgtatgatccagttaaccctggaggtcagcagaggagtggctcactgggggcaacagcaaatccgtcccatcaagtctgtcattcccagccccaccactactgacgtgacccatcaaaacacaggaaaactgctgaagaaggaagaaagatcttttgaagaagctattcctgcgaggaagctgaagaatttttacccgggggtagcggagcacaaggatatttctaagttggtcctgctcctttcttcctctgtaaattccctaagaaaggcagctcatgaggccctgcaggactttcagaagtacaagactctctggacagaggaccgcgatgtgaaagtgaaggaatttttggctaacaacccctctctgactgaaatcagatcagaaattctacactatgctacttttgaacaggagattgatgagttgaagcctattattgttgtaggagcacttgaattacatacagagccgatgaaattggccttatccatcgaggccaaggcatggaagatgttactctgtcgatatctgaatgaagaatacaaaaagaaaatgtcatacatgatagcatttattaatgaatacttgaaaaagttatctagacctattcgtgatttagatgatgtcagatttgcaatggaagccttgtcttgcatacgtgataatgaaattcaaatggacatgactttgggaccaattgaagaagcctatgctattttaaacagatttgaagttgaagtaaccaaagaagaatcagaagcagttgataccttaagatattctttcaacaaattgcagagcaaagctgtttcagtacaagaggacctagttcaagtgcagccaaagtttaaaagcaatctacttgagtctgtggaagtttttcgtgaggacgtgataaactttgcagaagcatatgaattggaaggacctatggttccaaatataccaccccaagaagctagcaacaggctacagatatttcaggccagtttcgatgatctgtggaggaaatttgttacgtattcatctggtgaacaactttttggattgcctgtgactgattatgaggttttacacaaaaccagaaaagaactcaacttgctgcagaagctgtatggattgtatgacaccgtaatgagcagtattagtggttattatgaaatactttggggagatgtagatattgaaaaaattaatgcagaactgctggaatttcaaaacagatgtcgtaaacttccaaaaggacttaaagattggcaagcttttttggatctcaaaaagagaattgatgatttcagtgagtcatgtcctctactggaaatgatgaccaataaggccatgaaacagagacactgggatagaatctccgagttaactggaaccccatttgatgtggaatctgattctttttgccttagaaatatcatggaagcaccactccttaaacataaggatgatattgaggatatttgcatatctgccattaaggagaaggatatcgaagccaagctgactcaggtgattgagaattggaccaaccaaaatctgagttttgcagcatttaagggaaaaggagagctcctgctcaaaggaaccgaatcgggagaaattatcactttgatggaggatagtttaatggtcttagggtctttactcagcaacagatacaatgctccatttaaaaaaaatatccagaattgggtgtataaattgtccacttcctcagatataattgaagagtggctcgtagtacagaacctttgggtttatcttgaagccgtctttgtaggtggagatattgccaaacagctgcctcaggaagcaaaacgttttcagaatattgacaagtcttggataaaaataatgcagcgagctcatgagaatcccaatgtgattaattgctgtgttggagatgaaaccatgggacaacttttacctcatttacatgagcagttggaagtatgtcagaagtcactcacagggtatttggagaagaaacgattactgtttccaagattcttctttgtatctgatccagttctcctggaaattcttggacaagccagtgattcccacaccatacagccgcatctccctgcagtatctgacaacatcaatgaggtgacatttcatgcaaaagactatgatcgcatcatggccgtcatatcaagagaaggagaaaaaattgttttggataattctgttatggccaaaggtcctgtggagatttggctactggatttgttaaaaatgcagatgtcatcattacataatataattagatccgctttctatcaaatcagtgattcaggatttcaactcttaccattcctcagccactttccagcacaggttggacttctgggaattcagatgttgtggacacacgattcagaagaggctttacgtaatgcaaaagatgacaggaaaatcatgcaagtgaccaatcagaaatttttggatattctaaatactctcattagtcagacaacacatgatctaagcaagtttgatagagtgaagttcgagactctaattaccatccatgtgcatcagagagatatttttgatgacttggtaaaaatgcatatcaaatcacctactgactttgaatggctaaaacagagtagattttattttaaggaagatttggatcaaactgtggtgtctattacagatgttgattttatttaccaaaatgaatttctgggatgtactgatcgtcttgttatcactccattaacagatagatgctatatcacgttagctcaggccttgggcatgaacatgggaggtgctcccgcaggacctgctggcactggcaaaacagaaaccacaaaagacatgggaaggtgtttgggaaaatatgtggtcgtgttcaattgctcagatcaaatggatttcagaggcctaggaaggattttcaaaggtcttgcacagtcgggttcctggggctgttttgatgagtttaacagaattgaattgcctgtattatcagtggcagcacaacaaatttatattgttttgacagcaagaaaagaaagaaagaaacagttcattttttctgatggtgattgtgttgatttaaatccagaatttggaatcttcttaacgatgaaccctggatatgctgggcgccaggaactaccagaaaacctaaaaatccagtttagaactgttgctatgatggttcctgatagacagatcattatgagagttaaacttgcaagctgtggttttcttgaaaatgttatcttggctcaaaaattttacgttctttacaaactctgtgaagagcaacttactaaacaggttcattatgactttggattgagaaatattctgtctgtattgaggactcttggatctcaaaaaagagccagaccagaagatagtgaattaagcattgtcatgagaggactaagagatatgaacctttccaaactggttgatgaagatgaacccctgttcctcagcttaatcaatgacctgttcccaggactgcaactggatagtaatacttatgcagaactgcaaaacgcagtagcccatcaggttcagatagagggtttgattaaccatccaccctggaacctgaaactcgtgcagttatatgagacgtctttggtacggcatggcttgatgactcttgggcccagtggttctggaaagacaaccgttatcacgattctaatgaaggcgcaaacagaatgcggaaggcctcatagagaaatgcgaatgaatccaaaagccattactgcacctcagatgtttggcagactggacactgctaccaatgactggacagatgggattttttctactctgtggagaaaaacattaaaagctaaaaaaggtgaaaacattttcctcattttagatggtcctgtggatgccatctggattgagaacttaaattccgttttggatgacaataaaactctgacgttagctaatggagatcgcattcccatggcccctagttgtaagcttctgtttgaagtccacaatatcgagaacgcctctcctgccacggtttctaggatgggcatggtctatatcagcagctctgctctcagctggaggccaatcttacaggcatggttgaagaaacgcactgcacaggaagctgctgtattcctgacactgtatgagaaagtctttgaagatacatacacatatatgaagctaaatctcaatcccaaaatgcagctcttggagtgcaactatattgtgcaatctctcaatcttctggaagggttaattccctccaaagaagaaggcggtgtttcctgtgtcgaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatgtatgagttttatgttactgattatggtgattgggagcactggaataagaaacttcagccttattattatccaactgacagtattccggaatattcatcaattttggttccaaatgttgacaatattagaacaaattttttgatagacaccattgcaaaacaacataaagctgttttgctcacaggagagcagggaactgcaaaaactgtcatggttaaggcctatttgaaaaaatatgatcctgaagtacagctatccaaaagtctaaacttttcatctgccacagaaccaatgatgtttcagagaacaattgaaagctacgtggataagcgaattggaagcacatatgggccaccaggagggagaaaaatgactgtatttattgatgatattaatatgcctgtgattaatgagtggggagatcaggtcattccccattagaagacttcaccggtgttgccagaagtccgcatgctcctggtgggatccccaacactttcctcccaccgacctacactgcttcattgacaccatctactttggctctaccaggacaagtcccattttgctctttatccctattcgcctcagacaccactagaagctcagtactc

SEQ ID NO: 4883 - DNA, 7688 bp, synthetic construct
  misc_feature 1..7688: note = Synthetic polypeptide
  source 1..7688: mol_type = other DNA
atgatgaaattgtatatagacaatgcagccccggataaactaaaaggactgtgcatattttttgttcgttgccgtaatgatgttgctataaatgttaaaactattcaagaggaagcgctctttactgttctggatgcgtcgaaaggactcttaaatggaattagggatatgttggcaaatatatttctaccagctgttcttgcaacaaacaactggggtgctttaaaccagtccaagcagggagaatctgaaaaacatattttcactgaaaccatcaacagatatctttcatttttagatggtgctagaataagtattgagggaacagtgaagttaaagacaatagacaatgttaatttttccaaactgcacacctttgaagaagtaactgctgcagccagcaactcagaaactgttcatcagctggaggaagtgctgatggtatggtacaaacagatcgaacaggtacttattgagagtgagcagatgagaaaagaagctggtgattcaggtccactcactgaattggaacactggaaacgcatgtcagccaagttcaactatatcattgagcagattaaagggccaagttgtaaggctgtcataaatgtgctaaatgttgcacactccaaactgctaaagaattggcgtgatttggatgcaagaatcactgatacagcaaatgaatccaaagataatgtcagatatttgtatactttggaaaaagtgtgtcaacctctctataaccatgacctagtttccatggcacatggaatacaaaatttgattaatgccatcagaatgattcacggtgtgtcaaggtattataatacctcagagagaatgacctcattgtttatcaaggtaacaaatcaaatggtaacagcatgtaaagcatatattactgatggaggattaaaccatgtatgggatcaggaaacgccagttgtactaaagaaaattcaggactgcatttttctattcaaggaatatcaggcatcttttcataaaacaaggaaactgatttcagaatcctcaggggaaaaatcttttgaggtttcagaaatgtatatatttggaaaatttgaagctttttgcaaaagactggagaagattacagaaatgataactgttgtgcaaacatattcaaccttgagtaattctaccatagaaggaatagatattatggcaataaaattcagaaatatataccaaggggttaagaaaaagcaatatgacattctggatccaagaaggacagaatttgacacagatttcttagatttcatgacaaaaatcaatggtttagaggtacaaatacaggcatttatgaacagtagttttgggaaaatcttatcttctcagcaggctcttcagctacttcaaaggtttcagaagctgaacattccctgtctgggattagaaataaaccacacaatagagcgtattcttcagtactatgtggctgaacttgatgctactaagaagctttatcattctcagaaagatgacccccctcttgctcgcaacatgccccctatagcaggaaaaatactctgggtgaggcagctctatcgccggataagtgagcccatcaattatttctttaaaaactcagacattttatcaagtccggacggtaaagctgtcatccgtcagtataacaagatctcctatgtgctggtggaattcgaggtggtctatcacacagcctggatcagagagatttcacagttgcattacgctttacaagccacgctttttgtgcgacatccagaaacagggaagttgctggttaatttcgatcccaaaattttggaagttgttcgggaaactaagtgtatgataaaaatgaagttggatgtaccagaacaggcaaagagattgctaaaattggaaagtaaattgaaagcagacaaactgtatttgcagggtcttctgcaatattatgatgagttatgtcaggaagtgccttctgtgtttgtcaatctgatgaccccaaaaatgaaaaaggtggaatctgtgttgaggcaaggactcacagtgttaacatggtcgtctttaacactggaaagcttctttcaagaagtcgaattagttttggatatgttcaatcaacttttaaagaagatcagtgacttgtgtgaaatgcatattgatacagttctgaaggagatagccaaaactgtgttgatttctctgcctgaaagtggtgctaccaaagtagaagatatgttgaccctcaatgagacatacacaaaagaatgggctgacattctaaaccacaaaagtaagcatgtggaagaagctgtcagagaacttatatcaatatttgagcagatttatgaagtgaaatacactgggaaagtaggaaaacagtcagaacagcggaaacacgttgtttttggaagtgaaacaggagagggtgaaaacaatgactatgaagctaatattgtgaatgagtttgatactcatgataaagaagatgaatttaaaaaggagtgtaaagaggtctttgcttttttctctcatcaattactagacagtcttcaaaaagctacacggttatctctggacacaatgaaaagaagaatatttgttgcaagcctttatgggcgaaagcagtcagaagatattatttcctttataaaaagtgaagtacatcttgcaattcctaatgtggtgatgattcctagtttggatgacattcaacaagccattaaccgtatgatccagttaaccctggaggtcagcagaggagtggctcactgggggcaacagcaaatccgtcccatcaagtctgtcattcccagccccaccactactgacgtgacccatcaaaacacaggaaaactgctgaagaaggaagaaagatcttttgaagaagctattcctgcgaggaagctgaagaatttttacccgggggtagcggagcacaaggatatttctaagttggtcctgctcctttcttcctctgtaaattccctaagaaaggcagctcatgaggccctgcaggactttcagaagtacaagactctctggacagaggaccgcgatgtgaaagtgaaggaatttttggctaacaacccctctctgactgaaatcagatcagaaattctacactatgctacttttgaacaggagattgatgagttgaagcctattattgttgtaggagcacttgaattacatacagagccgatgaaattggccttatccatcgaggccaaggcatggaagatgttactctgtcgatatctgaatgaagaatacaaaaagaaaatgtcatacatgatagcatttattaatgaatacttgaaaaagttatctagacctattcgtgatttagatgatgtcagatttgcaatggaagccttgtcttgcatacgtgataatgaaattcaaatggacatgactttgggaccaattgaagaagcctatgctattttaaacagatttgaagttgaagtaaccaaagaagaatcagaagcagttgataccttaagatattctttcaacaaattgcagagcaaagctgtttcagtacaagaggacctagttcaagtgcagccaaagtttaaaagcaatctacttgagtctgtggaagtttttcgtgaggacgtgataaactttgcagaagcatatgaattggaaggacctatggttccaaatataccaccccaagaagctagcaacaggctacagatatttcaggccagtttcgatgatctgtggaggaaatttgttacgtattcatctggtgaacaactttttggattgcctgtgactgattatgaggttttacacaaaaccagaaaagaactcaacttgctgcagaagctgtatggattgtatgacaccgtaatgagcagtattagtggttattatgaaatactttggggagatgtagatattgaaaaaattaatgcagaactgctggaatttcaaaacagatgtcgtaaacttccaaaaggacttaaagattggcaagcttttttggatctcaaaaagagaattgatgatttcagtgagtcatgtcctctactggaaatgatgaccaataaggccatgaaacagagacactgggatagaatctccgagttaactggaaccccatttgatgtggaatctgattctttttgccttagaaatatcatggaagcaccactccttaaacataaggatgatattgaggatatttgcatatctgccattaaggagaaggatatcgaagccaagctgactcaggtgattgagaattggaccaaccaaaatctgagttttgcagcatttaagggaaaaggagagctcctgctcaaaggaaccgaatcgggagaaattatcactttgatggaggatagtttaatggtcttagggtctttactcagcaacagatacaatgctccatttaaaaaaaatatccagaattgggtgtataaattgtccacttcctcagatataattgaagagtggctcgtagtacagaacctttgggtttatcttgaagccgtctttgtaggtggagatattgccaaacagctgcctcaggaagcaaaacgttttcagaatattgacaagtcttggataaaaataatgcagcgagctcatgagaatcccaatgtgattaattgctgtgttggagatgaaaccatgggacaacttttacctcatttacatgagcagttggaagtatgtcagaagtcactcacagggtatttggagaagaaacgattactgtttccaagattcttctttgtatctgatccagttctcctggaaattcttggacaagccagtgattcccacaccatacagccgcatctccctgcagtatctgacaacatcaatgaggtgacatttcatgcaaaagactatgatcgcatcatggccgtcatatcaagagaaggagaaaaaattgttttggataattctgttatggccaaaggtcctgtggagatttggctactggatttgttaaaaatgcagatgtcatcattacataatataattagatccgctttctatcaaatcagtgattcaggatttcaactcttaccattcctcagccactttccagcacaggttggacttctgggaattcagatgttgtggacacacgattcagaagaggctttacgtaatgcaaaagatgacaggaaaatcatgcaagtgaccaatcagaaatttttggatattctaaatactctcattagtcagacaacacatgatctaagcaagtttgatagagtgaagttcgagactctaattaccatccatgtgcatcagagagatatttttgatgacttggtaaaaatgcatatcaaatcacctactgactttgaatggctaaaacagagtagattttattttaaggaagatttggatcaaactgtggtgtctattacagatgttgattttatttaccaaaatgaatttctgggatgtactgatcgtcttgttatcactccattaacagatagatgctatatcacgttagctcaggccttgggcatgaacatgggaggtgctcccgcaggacctgctggcactggcaaaacagaaaccacaaaagacatgggaaggtgtttgggaaaatatgtggtcgtgttcaattgctcagatcaaatggatttcagaggcctaggaaggattttcaaaggtcttgcacagtcgggttcctggggctgttttgatgagtttaacagaattgaattgcctgtattatcagtggcagcacaacaaatttatattgttttgacagcaagaaaagaaagaaagaaacagttcattttttctgatggtgattgtgttgatttaaatccagaatttggaatcttcttaacgatgaaccctggatatgctgggcgccaggaactaccagaaaacctaaaaatccagtttagaactgttgctatgatggttcctgatagacaggttcattatgactttggattgagaaatattctgtctgtattgaggactcttggatctcaaaaaagagccagaccagaagatagtgaattaagcattgtcatgagaggactaagagatatgaacctttccaaactggttgatgaagatgaacccctgttcctcagcttaatcaatgacctgttcccaggactgcaactggatagtaatacttatgcagaactgcaaaacgcagtagcccatcaggttcagatagagggtttgattaaccatccaccctggaacctgaaactcgtgcagttatatgagacgtctttggtacggcatggcttgatgactcttgggcccagtggttctggaaagacaaccgttatcacgattctaatgaaggcgcaaacagaatgcggaaggcctcatagagaaatgcgaatgaatccaaaagccattactgcacctcagatgtttggcagactggacactgctaccaatgactggacagatgggattttttctactctgtggagaaaaacattaaaagctaaaaaaggtgaaaacattttcctcattttagatggtcctgtggatgccatctggattgagaacttaaattccgttttggatgacaataaaactctgacgttagctaatggagatcgcattcccatggcccctagttgtaagcttctgtttgaagtccacaatatcgagaacgcctctcctgccacggtttctaggatgggcatggtctatatcagcagctctgctctcagctggaggccaatcttacaggcatggttgaagaaacgcactgcacaggaagctgctgtattcctgacactgtatgagaaagtctttgaagatacatacacatatatgaagctaaatctcaatcccaaaatgcagctcttggagtgcaactatattgtgcaatctctcaatcttctggaagggttaattccctccaaagaagaaggcggtgtttcctgtgtcgaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatgtatgagttttatgttactgattatggtgattgggagcactggaataagaaacttcagccttattattatccaactgacagtattccggaatattcatcaattttggttccaaatgttgacaatattagaacaaattttttgatagacaccattgcaaaacaacataaagctgttttgctcacaggagagcagggaactgcaaaaactgtcatggttaaggcctatttgaaaaaatatgatcctgaagtacagctatccaaaagtctaaacttttcatctgccacagaaccaatgatgtttcagagaacaattgaaagctacgtggataagcgaattggaagcacatatgggccaccaggagggagaaaaatgactgtatttattgatgatattaatatgcctgtgattaatgagtggggagatcaggtcattccccattagaagacttcaccggtgttgccagaagtccgcatgctcctggtgggatccccaacactttcctcccaccgacctacactgcttcattgacaccatctactttggctctaccaggacaagtcccattttgctctttatccctattcgcctcagacaccactagaagctcagtactc

SEQ ID NO: 4884 - DNA, 232 bp, synthetic construct; identical to SEQ ID NO: 1243
  misc_feature 1..232: note = Synthetic polypeptide
  source 1..232: mol_type = other DNA

SEQ ID NO: 4885 - DNA, 1497 bp, synthetic construct; identical to SEQ ID NO: 4488
  misc_feature 1..1497: note = Synthetic polypeptide
  source 1..1497: mol_type = other DNA

SEQ ID NO: 4886 - DNA, 897 bp, synthetic construct; identical to SEQ ID NO: 2579
  misc_feature 1..897: note = Synthetic polypeptide
  source 1..897: mol_type = other DNA

SEQ ID NO: 4887 - DNA, 2240 bp, synthetic construct
  misc_feature 1..2240: note = Synthetic polypeptide
  source 1..2240: mol_type = other DNA
atgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagaaaaagtctcaattttggaaaagaaaggctgcctggagaaagatttgaagtataaaattataatagcaagtaattcaaaataacctaatgcctaagagaagagaaattactaaaaaatttgatattcaccaatttgaacattttataatcctaacaatggattattagaaatacaacataatagaagatacttagaataaaatatgaagtaagcaaaaaggttgtaaaattgtaaatataatttgattaatttttatttaacaaataca

SEQ ID NO: 4888 - DNA, 1316 bp, synthetic construct
  misc_feature 1..1316: note = Synthetic polypeptide
  source 1..1316: mol_type = other DNA
atgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagaaaaagtctcaattttggaaaagaaaggctgcctggagaaagatttgaagtataaaattataatagcaagtaattcaaaataacctaatgcctaagagaagagaaattactaaaaaatttgatattcaccaatttgaacattttataatcctaacaatggattattagaaatacaacataatagaagatacttagaataaaatatgaagtaagcaaaaaggttgtaaaattgtaaatataatttgattaatttttatttaacaaataca

SEQ ID NO: 4889 - DNA, 2195 bp, synthetic construct
  misc_feature 1..2195: note = Synthetic polypeptide
  source 1..2195: mol_type = other DNA
atgactgcaggatctagctatccattgtttctggccgcctatgcgtgcactgggtgtctggcagagaggctggggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagaaaaagtctcaattttggaaaagaaaggctgcctggagaaagatttgaagtataaaattataatagcaagtaattcaaaataacctaatgcctaagagaagagaaattactaaaaaatttgatattcaccaatttgaacattttataatcctaacaatggattattagaaatacaacataatagaagatacttagaataaaatatgaagtaagcaaaaaggttgtaaaattgtaaatataatttgattaatttttatttaacaaataca

SEQ ID NO: 4890 - DNA, 436 bp, synthetic construct; identical to SEQ ID NO: 1262
  misc_feature 1..436: note = Synthetic polypeptide
  source 1..436: mol_type = other DNA

SEQ ID NO: 4891 - DNA, 858 bp, synthetic construct
  misc_feature 1..858: note = Synthetic polypeptide
  source 1..858: mol_type = other DNA
atggcgctgcggcgcctcctgctgctgctgctgctctcgctggagtccctggacctgctgcccagcgtccacggagcccgcggccgcgccgccaaccggaccctgagtgcaggcggcgctgccgtcgggggccggagggccgggggcgccctggcacggggcggccgcgagctgaacggcaccgcccgggcgcccggaatcccggaggcgggaagccggcgggggcagcccgcggcggctgtggcggcggcggccagcgcggccgtcacctacgagacgtgctggggctactacgacgtgagcggccagtacgacaaggagttcgagtgtaacaacagcgagagcggctacctgtactgctgcggtacctgctactaccgcttctgctgcaagaagcgccacgagaagctggaccagcgccagtgcaccaactaccagagcccggtgtgggtacagacgcccagcaccaaggtggtgtcgccggggcccgagaacaagtacgacccggagaaggacaagaccaacttcaccgtctacatcacctgcggggtgatcgccttcgtcatcgtggccggcgtcttcgccaaggtctcctacgacaaggcccaccgccctccacgggagatgaacatccacagggctctggctgacatcttaagacaacagggaccaatccccatagcacactgtgaaagagaaactatctcggctatcgatacctctcccaaagagaacacgccggtcagatcgtcctccaaaaaccactacactcctgtgcgtacggccaagcagactccaggaccaagaacatcacttggaaaatcctagttgctcaagagctgtttgttcagggaatga

SEQ ID NO: 4892 - DNA, 340 bp, synthetic construct
  misc_feature 1..340: note = Synthetic polypeptide
  source 1..340: mol_type = other DNA
gaccaacttcaccgtctacatcacctgcggggtgatcgccttcgtcatcgtggccggcgtcttcgccaaggtctcctacgacaaggcccaccgccctccacgggagatgaacatccacagggctctggctgacatcttaagacaacagggaccaatccccatagcacactgtgaaagagaaactatctcggctatcgatacctctcccaaagagaacacgccggtcagatcgtcctccaaaaaccactacactcctgtgcgtacggccaagcagactccaggaccaagaacatcacttggaaaatcctagttgctcaagagctgtttgttcagggaatga

SEQ ID NO: 4893 - DNA, 1428 bp, synthetic construct
  misc_feature 1..1428: note = Synthetic polypeptide
  source 1..1428: mol_type = other DNA
atgctcactcgagtgaaatctgccgtggccaatttcatgggcggcatcatggctggcagctcaggctccgagcacggcggcggcagctgcggaggctcggacctgcccctgcgtttcccctacgggcggccagagttcctggggctgtctcaggacgaggtggagtgcagcgccgaccacatcgcccgccccatcctcatcctcaaggagactcggcggctgccctgggccactggctacgcagaggttatcaatgccgggaagagcacacacaatgaagaccaagccagctgtgaggtgctcactgtgaagaagaaggcaggggccgtgacctcaaccccaaacaggaactcatccaagagacggtcctcccttcccaatggggaagggctgcagctgaaggagaactcggaatccgagggtgtttcctgccactattggtcgctgtttgacgggcacgcggggtccggggccgcggtggtggcgtcacgcctgctgcagcaccacatcacggagcagctgcaggacatcgtggacatcctgaagaactccgccgtcctgccccctacctgcctgggggaggagcctgagaacacgcccgccaacagccggactctgacccgggcagcctccctgcgcggaggggtgggggccccgggctcccccagcacgccccccacacgcttctttaccgagaagaagattccccatgagtgcctggtcatcggagcgcttgaaagtgcattcaaggaaatggacctacagatagaacgagagaggagttcatataatatatctggtggctgcacggccctcattgtgatttgccttttggggaagctgtatgttgcaaatgctggggatagcagggccataatcatcagaaatggagaaattatccccatgtcttcagaatttacccccgagacggagcgccagcgacttcagtacctggcattcatgcagcctcacttgctgggaaatgagttcacacatttggagtttccaaggagagtacagagaaaggagcttggaaagaagatgctctacagggactttaatatgacaggctgggcatacaaaaccattgaggatgaggacttgaagttcccccttatatatggagaaggcaagaaggcccgggtaatggcaactattggagtgaccaggggacttggggaccatgacctgaaggtgcatgactccaacatctacattaaaccattcctgtcttcagctccagaggtaagaatctacgatctttcaaaatatgatcatggatcagatgatgtgctgatcttggccactgatggactctgggacgttttatcaaatgaagaagtagcagaagcaatcactcagtttcttcctaactgtgatccagatgatcctcacaggtgattctgatgctgctaaaattcaagaacc

SEQ ID NO: 4894 - DNA, 770 bp, synthetic construct; identical to SEQ ID NO: 3389
  misc_feature 1..770: note = Synthetic polypeptide
  source 1..770: mol_type = other DNA

SEQ ID NO: 4895 - DNA, 867 bp, synthetic construct
  misc_feature 1..867: note = Synthetic polypeptide
  source 1..867: mol_type = other DNA
atgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgttttccttcttttgagaaaactgaagccatggtattctgaggactagagatgactcaacacagctggtgaatctcctcatatgcaatccactgggcttgatctgcttcagattgctgatgcactgctgctaaagctatacatttaaaaccctcactaaaggatcagggaccatcatggaagaggaggaaacatgaaattgtaagagccagattcggggggtagagtgtggaggtcag

SEQ ID NO: 4896 - DNA, 738 bp, synthetic construct
  misc_feature 1..738: note = Synthetic polypeptide
  source 1..738: mol_type = other DNA
atgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgttttccttcttttgagaaaactgaagccatggtattctgaggactagagatgactcaacacagctggtgaatctcctcatatgcaatccactgggcttgatctgcttcagattgctgatgcactgctgctaaagctatacatttaaaaccctcactaaaggatcagggaccatcatggaagaggaggaaacatgaaattgtaagagccagattcggggggtagagtgtggaggtcag

SEQ ID NO: 4897 - DNA, 869 bp, synthetic construct
  misc_feature 1..869: note = Synthetic polypeptide
  source 1..869: mol_type = other DNA
tcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagtgtacgcctgggccagatgtcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgttttccttcttttgagaaaactgaagccatggtattctgaggactagagatgactcaacacagctggtgaatctcctcatatgcaatccactgggcttgatctgcttcagattgctgatgcactgctgctaaagctatacatttaaaaccctcactaaaggatcagggaccatcatggaagaggaggaaacatgaaattgtaagagccagattcggggggtagagtgtggaggtcag

SEQ ID NO: 4898 - DNA, 392 bp, synthetic construct; identical to SEQ ID NO: 410
  misc_feature 1..392: note = Synthetic polypeptide
  source 1..392: mol_type = other DNA

SEQ ID NO: 4899 - DNA, 775 bp, synthetic construct; identical to SEQ ID NO: 215
  misc_feature 1..775: note = Synthetic polypeptide
  source 1..775: mol_type = other DNA

SEQ ID NO: 4900 - DNA, 980 bp, synthetic construct; identical to SEQ ID NO: 139
  misc_feature 1..980: note = Synthetic polypeptide
  source 1..980: mol_type = other DNA

SEQ ID NO: 4901 - DNA, 1256 bp, synthetic construct; identical to SEQ ID NO: 140
  misc_feature 1..1256: note = Synthetic polypeptide
  source 1..1256: mol_type = other DNA

SEQ ID NO: 4902 - DNA, 1277 bp, synthetic construct; identical to SEQ ID NO: 142
  misc_feature 1..1277: note = Synthetic polypeptide
  source 1..1277: mol_type = other DNA

SEQ ID NO: 4903 - DNA, 427 bp, synthetic construct
  misc_feature 1..427: note = Synthetic polypeptide
  source 1..427: mol_type = other DNA
atgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtatcattagactggcaaaggatcatccgtggcaccaaaagccttaagaacc

SEQ ID NO: 4904 - DNA, 292 bp, synthetic construct
  misc_feature 1..292: note = Synthetic polypeptide
  source 1..292: mol_type = other DNA
atggaacgttgggccatgcgtgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtatcattagactggcaaaggatcatccgtggcaccaaaagccttaagaacc

SEQ ID NO: 4905 - DNA, 393 bp, synthetic construct
  misc_feature 1..393: note = Synthetic polypeptide
  source 1..393: mol_type = other DNA
gaaatccagctagtcctgtctgtcataacctcctgggctcctgtttgcctctctccctccagctcctttgctcttggtggcctctgattggggccaacactacaagcaaggtcaagcgcagtgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtatcattagactggcaaaggatcatccgtggcaccaaaagccttaagaacc

SEQ ID NO: 4906 - DNA, 500 bp, synthetic construct; identical to SEQ ID NO: 204
  misc_feature 1..500: note = Synthetic polypeptide
  source 1..500: mol_type = other DNA

SEQ ID NO: 4907 - DNA, 656 bp, synthetic construct; identical to SEQ ID NO: 205
  misc_feature 1..656: note = Synthetic polypeptide
  source 1..656: mol_type = other DNA

SEQ ID NO: 4908 - DNA, 524 bp, synthetic construct; identical to SEQ ID NO: 207
  misc_feature 1..524: note = Synthetic polypeptide
  source 1..524: mol_type = other DNA

SEQ ID NO: 4909 - DNA, 878 bp, synthetic construct
  misc_feature 1..878: note = Synthetic polypeptide
  source 1..878: mol_type = other DNA
atggctcgactccccgctggcattcgcttcatcatctcattctccagggatcagtggtacagagccttcatttttattttgacatttctgctgtatgcaagttttcacttatctcgaaagcctatcagcatagttaagggtgagctccacaagtactgcactgcttgggatgaagctgacgtcaggttcagcagccagaacaggaagtctgggtccgctgccccccaccagctccctgacaatgagaccgactgtggctgggcaccgtttgataagaacaactatcagcagctgcttggggccctggactactccttcctgtgcgcctatgccgtggggatgtacctcagtggcatcattggggagcgcctgccgattaggtattacctaactttcgggatgctcgccagcggagccttcaccgccctgttcggcttagggtatttctacaacatccacagtttcggattctacgtggtaactcaggtcatcaacgggctggtgcagaccaccggctggcccagcgtcgtcacctgcctcggcaactggtttggaaaaggaaggagaggtttgattatgggggtctggaactcccacacctccgtgggcaacatcttggggtcattgatcgctggctactgggtgtccacatgctggggcctgtccttcgtcgtgcctggagccatcgtggcagccatggggatagtgtgctttctcttcctcattgaacatccgaacgacgtcaggtgctcctccaccctggtgacgaatctcttcttcacaccgcacttgcagagactgtattgatacagacgccagagcacatcagcccttgcacaacacagtccagtggctccatgtcgccccgtgtgaaatcc

SEQ ID NO: 4910 - DNA, 3371 bp, synthetic construct; identical to SEQ ID NO: 1268
  misc_feature 1..3371: note = Synthetic polypeptide
  source 1..3371: mol_type = other DNA

SEQ ID NO: 4911 - DNA, 3206 bp, synthetic construct; identical to SEQ ID NO: 1269
  misc_feature 1..3206: note = Synthetic polypeptide
  source 1..3206: mol_type = other DNA

SEQ ID NO: 4912 - DNA, 5018 bp, synthetic construct
  misc_feature 1..5018: note = Synthetic polypeptide
  source 1..5018: mol_type = other DNA
atggtgggagaactccgctacagggaattcagggtgcccctggggcccggcttacatgcctatcctgatgagctgatccgccagcgcgtgggccatgatgggcatcctgagtaccagatccgttggctcatcctgcggcgtggcgatgagggggacgggggctctggccaagtggactgcaaggctgagcacatcctgctgtggatgtccaaggatgagatctatgccaactgccacaagatgctgggcgaggatggccaggtcatcgggccctcccaggagtctgcaggggaggttggggccctggacaaatctgtgctggaggagatggaaaccgacgtgaagtccctcattcagagagcccttcggcagctggaggagtgtgtgggcactatccctcctgctcctctacttcacactgtccacgtgctcagcgcctatgccagcattgagcccctcactggagtattcaaggacccaagggtcctggacttgctcatgcacatgttgagtagtcctgattatcagattcgctggagtgcaggccggatgatacaagccctgtcctcccatgacgctgggacccggactcagatccttctgtcactgagccaacaagaagccattgagaaacacctggattttgacagccgctgtgctctgctagcactgtttgcacaggccacgctctctgaacaccccatgtctttcgagggcattcagctaccacaggtcccaggaagggtgctcttctccctggtgaagcggtatttgcatgtcacctcgctcctggatcagctgaacgacagtgctgcggagccaggagcccagaacacctctgctcctgaggagttgagtggggagaggggtcaactggagctggagttcagtatggccatgggcaccctgatctcggagctggtgcaagccatgcgctgggaccaggcctcagacagaccaaggagctcagcacggtcccccggttccatcttccagcctcagctggcagatgtgagcccagggctccccgctgcccaggctcagccctccttcaggaggtcaagacgttttcgccctcgttctgagttcgcaagtggcaatacctatgctttgtatgtgcgggacacactgcagccggggatgcgagtgcggatgctggatgattatgaggagatcagtgccggggatgagggcgagtttcggcagagcaacaacggtgtgcctcctgtgcaggtattttgggagtcaacaggccgcacctattgggtgcactggcacatgctggagatcttgggctttgaggaagacattgaggacatggttgaggctgatgagtaccaaggggcagtggccagtagagtcctgggtagagccctgcctgcctggcgctggaggcccatgacagaactctatgctgtgccttatgtgctgcctgaggatgaggacactgaggagtgtgaacacctgaccctggctgagtggtgggaactcctcttcttcatcaagaagctggatggacctgaccatcaggaggttctccagatcctccaggagaacctagatggggagattctggatgatgagatcctagctgaactggccgtgcccatagaattggcccaggacttgctgctgactctgccacagcgactcaatgacagtgccctcagggacctgatcaactgccatgtctacaagaagtatgggcctgaagccctagcagggaaccaagcctacccatcccttctagaagcccaagaagatgtcctcctgctagacgcgcaggcccaggctaaggactcagaagatgcagccaaagtggaagcaaaagaacccccatctcagagtcccaacactcccctgcagcgtctggtggagggttatggtccagctgggaaaatcctcctggatctagagcaagccctcagctcagaggggacccaggagaacaaggtcaagccactcctgctgcagctgcagcggcagccgcagcccttcctggcactgatgcagagcctggacactccggagactaacaggaccctgcacctgactgtgctgagaatcctgaagcagctggtggacttccccgaggcactgctgctcccctggcacgaggccgtggatgcctgcatggcctgcctgcggtccccaaacactgatcgagaggtgctccaggaactgattttcttcctgcaccgcctgacctcagtgagcagggactatgccgtggtgctgaatcagctgggagcaagagacgctatctccaaggccctggaaaagcacctgggaaagctggagctggctcaggagctgcgggacatggtgttcaagtgtgagaagcatgcccacctctaccgcaaactcatcaccaacatcctgggaggctgcatccagatggtgctgggccagatcgaagaccacagacgaacccaccaacccatcaacatccctttctttgatgtgttcctcagatacctgtgccagggctccagtgtggaagtgaaggaggacaagtgctgggagaaggtggaggtgtcctccaacccgcaccgggccagcaagctgacggaccacaaccccaagacctattgggagtccaacggcagcgccggctcccactacatcaccctgcacatgcgccggggcatcctcatcaggcaactgactctgcttgtggctagtgaggactcgagttacatgccggcccgagtggtggtgtgcgggggtgatagcactagctctcttcacacggaactcaactcggtgaatgtgatgccctctgccagccgggtgatcctcctggagaacctgacccgcttctggcccatcatccagatccgcataaagcgctgccagcagggtggcattgatacgcgcattcgggggttagagatcctaggccccaagcccacgttctggccagtgttccgggagcagctctgtcgtcacacacgcctcttctacatggttcgggcacaggcctggagccaggacatggcagaggaccgcaggagcctcctgcacctgagttctagactcaacggtgctctgcgccaggagcagaattttgctgaccgcttcctccctgatgacgaggctgcccaagctctgggcaagacctgctgggaggccctggtcagccccgtggtgcagaacatcacctcccctgatgaggatggcattagccccctgggttggctgctggaccagtacctggagtgtcaggaagctgtcttcaacccccagagccgcggcccagctttcttctcgcgggtgcgccgtctcactcacctgctggtgcatgtcgagccctgtgaggcaccccctcctgtggtggccactcctcggcccaaaggcagaaacagaagccacgactggagctccttggctacccggggccttccaagcagcatcatgagaaacctgacgcgctgttggcgggccgtggtggagaagcaggtgaacaattttctgacctcatcctggcgggatgatgactttgtgccacgctactgtgagcactttaatattctgcagaactcaagctctgaactgtttgggcctcgggcagccttcttgctggcgctgcaaaatggctgtgcgggagccttgctgaagctcccttttctcaaagctgcccacgtgagtgagcagttcgcccggcacattgaccagcagatccagggcagccggatcggtggagcccaggaaatggagaggctggcacagctgcagcaatgcctgcaagctgtcctgattttctccggcttggagatagccaccacttttgagcattattaccagcactacatggcggaccgtctcctgggcgtggtctcgagctggctggagggggccgtgctggagcagatcggtccctgcttccccaaccgcctcccccagcagatgttgcagagcctgagcacctctaaggagctgcagcgccagttccacgtctaccagctccagcagctggatcaggaactcctgaagctggaggatacagagaagaaaatacaggtgggccttggggccagtggcaaggagcacaagagcgagaaggaagaggaagctggggcagcagcagtggtggatgtggcggagggagaggaggaagaggaggagaatgaggacctctactatgaaggggcaatgccagaagtgtctgtgcttgtcctgtcccgacactcctggcctgttgcctcaatctgccacacactgaaccccagaacctgcctgccctcctacctgaggggcactttgaacagatactccaacttctacaacaagagtcagagccaccctgcccttgagcgaggctcacagaggcgactgcagtggacgtggctgggctgggctgagctgcagtttgggaaccagaccctgcatgtgtccaccgtgcagatgtggctactgctgtatctcaacgacctgaaggcggtctctgtggagagtctgctggcgttctcagggctctccgcagacatgctcaatcaggcgattgggcccctcacctcttcaagaggccccctggaccttcacgagcaaaaggatataccaggaggggtcctcaagattcgagatggcagcaaggaacccaggtcgagatgggacattgtgcggctcatcccacctcagacgtacctgcaagctgagggtgaagacggccagaacttggagaagagacggaatcttctgaactgcctcatcgtccgaatcctcaaggcccatggagatgaggggctgcacattgaccagcttgtctgtctggtgctggaggcttggcagaagggcccgtgtcctcccaggggtttggtcagcagccttggtaaggggtctgcatgcagcagcactgacgtcctctcctgcatcctacacctcctgggcaagggcacgctgagacgccatgacgaccggccccaggctggagatccaagcccaacttggccactcaccagatggtttgtaacttgggcagattatcgagcagggtttaattctcctcgtttgtggaa

SEQ ID NO: 4913 - DNA, 5270 bp, synthetic construct
  misc_feature 1..5270: note = Synthetic polypeptide
  source 1..5270: mol_type = other DNA
atgagccgtggcttttggctggcggagccgctggcagggaccgggccccaccctgccccagtggctgccgactcacgcgggtgcagctctgttccgcggaggcacgccccctcccgtctctccgtctcgaccccctcgcggggcccaggtgccaggatggtgggagaactccgctacagggaattcagggtgcccctggggcccggcttacatgcctatcctgatgagctgatccgccagcgcgtgggccatgatgggcatcctgagtaccagatccgttggctcatcctgcggcgtggcgatgagggggacgggggctctggccaagtggactgcaaggctgagcacatcctgctgtggatgtccaaggatgagatctatgccaactgccacaagatgctgggcgaggatggccaggtcatcgggccctcccaggagtctgcaggggaggttggggccctggacaaatctgtgctggaggagatggaaaccgacgtgaagtccctcattcagagagcccttcggcagctggaggagtgtgtgggcactatccctcctgctcctctacttcacactgtccacgtgctcagcgcctatgccagcattgagcccctcactggagtattcaaggacccaagggtcctggacttgctcatgcacatgttgagtagtcctgattatcagattcgctggagtgcaggccggatgatacaagccctgtcctcccatgacgctggtgaggggcagtgtggggaggaagggaaagcaggagaagggctgggtcggctcagggactcacaggacactgtggcaggagcctctgatctcatcaggacccggactcagatccttctgtcactgagccaacaagaagccattgagaaacacctggattttgacagccgctgtgctctgctagcactgtttgcacaggccacgctctctgaacaccccatgtctttcgagggcattcagctaccacaggtcccaggaagggtgctcttctccctggtgaagcggtatttgcatgtcacctcgctcctggatcagctgaacgacagtgctgcggagccaggagcccagaacacctctgctcctgaggagttgagtggggagaggggtcaactggagctggagttcagtatggccatgggcaccctgatctcggagctggtgcaagccatgcgctgggaccaggcctcagacagaccaaggagctcagcacggtcccccggttccatcttccagcctcagctggcagatgtgagcccagggctccccgctgcccaggctcagccctccttcaggaggtcaagacgttttcgccctcgttctgagttcgcaagtggcaatacctatgctttgtatgtgcgggacacactgcagccggggatgcgagtgcggatgctggatgattatgaggagatcagtgccggggatgagggcgagtttcggcagagcaacaacggtgtgcctcctgtgcaggtattttgggagtcaacaggccgcacctattgggtgcactggcacatgctggagatcttgggctttgaggaagacattgaggacatggttgaggctgatgagtaccaaggggcagtggccagtagagtcctgggtagagccctgcctgcctggcgctggaggcccatgacagaactctatgctgtgccttatgtgctgcctgaggatgaggacactgaggagtgtgaacacctgaccctggctgagtggtgggaactcctcttcttcatcaagaagctggatggacctgaccatcaggaggttctccagatcctccaggagaacctagatggggagattctggatgatgagatcctagctgaactggccgtgcccatagaattggcccaggacttgctgctgactctgccacagcgactcaatgacagtgccctcagggacctgatcaactgccatgtctacaagaagtatgggcctgaagccctagcagggaaccaagcctacccatcccttctagaagcccaagaagatgtcctcctgctagacgcgcaggcccaggctaaggactcagaagatgcagccaaagtggaagcaaaagaacccccatctcagagtcccaacactcccctgcagcgtctggtggagggttatggtccagctgggaaaatcctcctggatctagagcaagccctcagctcagaggggacccaggagaacaaggtcaagccactcctgctgcagctgcagcggcagccgcagcccttcctggcactgatgcagagcctggacactccggagactaacaggaccctgcacctgactgtgctgagaatcctgaagcagctggtggacttccccgaggcactgctgctcccctggcacgaggccgtggatgcctgcatggcctgcctgcggtccccaaacactgatcgagaggtgctccaggaactgattttcttcctgcaccgcctgacctcagtgagcagggactatgccgtggtgctgaatcagctgggagcaagagacgctatctccaaggccctggaaaagcacctgggaaagctggagctggctcaggagctgcgggacatggtgttcaagtgtgagaagcatgcccacctctaccgcaaactcatcaccaacatcctgggaggctgcatccagatggtgctgggccagatcgaagaccacagacgaacccaccaacccatcaacatccctttctttgatgtgttcctcagatacctgtgccagggctccagtgtggaagtgaaggaggacaagtgctgggagaaggtggaggtgtcctccaacccgcaccgggccagcaagctgacggaccacaaccccaagacctattgggagtccaacggcagcgccggctcccactacatcaccctgcacatgcgccggggcatcctcatcaggcaactgactctgcttgtggctagtgaggactcgagttacatgccggcccgagtggtggtgtgcgggggtgatagcactagctctcttcacacggaactcaactcggtgaatgtgatgccctctgccagccgggtgatcctcctggagaacctgacccgcttctggcccatcatccagatccgcataaagcgctgccagcagggtggcattgatacgcgcattcgggggttagagatcctaggccccaagcccacgttctggccagtgttccgggagcagctctgtcgtcacacacgcctcttctacatggttcgggcacaggcctggagccaggacatggcagaggaccgcaggagcctcctgcacctgagttctagactcaacggtgctctgcgccaggagcagaattttgctgaccgcttcctccctgatgacgaggctgcccaagctctgggcaagacctgctgggaggccctggtcagccccgtggtgcagaacatcacctcccctgatgaggatggcattagccccctgggttggctgctggaccagtacctggagtgtcaggaagctgtcttcaacccccagagccgcggcccagctttcttctcgcgggtgcgccgtctcactcacctgctggtgcatgtcgagccctgtgaggcaccccctcctgtggtggccactcctcggcccaaaggcagaaacagaagccacgactggagctccttggctacccggggccttccaagcagcatcatgagaaacctgacgcgctgttggcgggccgtggtggagaagcaggtgaacaattttctgacctcatcctggcgggatgatgactttgtgccacgctactgtgagcactttaatattctgcagaactcaagctctgaactgtttgggcctcgggcagccttcttgctggcgctgcaaaatggctgtgcgggagccttgctgaagctcccttttctcaaagctgcccacgtgagtgagcagttcgcccggcacattgaccagcagatccagggcagccggatcggtggagcccaggaaatggagaggctggcacagctgcagcaatgcctgcaagctgtcctgattttctccggcttggagatagccaccacttttgagcattattaccagcactacatggcggaccgtctcctgggcgtggtctcgagctggctggagggggccgtgctggagcagatcggtccctgcttccccaaccgcctcccccagcagatgttgcagagcctgagcacctctaaggagctgcagcgccagttccacgtctaccagctccagcagctggatcaggaactcctgaagctggaggatacagagaagaaaatacaggtgggccttggggccagtggcaaggagcacaagagcgagaaggaagaggaagctggggcagcagcagtggtggatgtggcggagggagaggaggaagaggaggagaatgaggacctctactatgaaggggcaatgccagaagtgtctgtgcttgtcctgtcccgacactcctggcctgttgcctcaatctgccacacactgaaccccagaacctgcctgccctcctacctgaggggcactttgaacagatactccaacttctacaacaagagtcagagccaccctgcccttgagcgaggctcacagaggcgactgcagtggacgtggctgggctgggctgagctgcagtttgggaaccagaccctgcatgtgtccaccgtgcagatgtggctactgctgtatctcaacgacctgaaggcggtctctgtggagagtctgctggcgttctcagggctctccgcagacatgctcaatcaggcgattgggcccctcacctcttcaagaggccccctggaccttcacgagcaaaaggatataccaggaggggtcctcaagattcgagatggcagcaaggaacccaggtcgagatgggacattgtgcggctcatcccacctcagacgtacctgcaagctgagggtgaagacggccagaacttggagaagagacggaatcttctgaactgcctcatcgtccgaatcctcaaggcccatggagatgaggggctgcacattgaccagcttgtctgtctggtgctggaggcttggcagaagggcccgtgtcctcccaggggtttggtcagcagccttggtaaggggtctgcatgcagcagcactgacgtcctctcctgcatcctacacctcctgggcaagggcacgctgagacgccatgacgaccggccccaggctggagatccaagcccaacttggccactcaccagatggtttgtaacttgggcagattatcgagcagggtttaattctcctcgtttgtggaa

SEQ ID NO: 4914 - DNA, 592 bp, synthetic construct
  misc_feature 1..592: note = Synthetic polypeptide
  source 1..592: mol_type = other DNA
atgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggagcagtggctcacgcctgtaatcccagctctttgggaggccgaagcgggtagatcaccagaggtcaggagttcgagaccagcctggccaacatggtgaaaccccgtctctgctaaaaatacaaaaaattagccgggtgtggtggcgcacacctgtaatcccaactacttgggaggctgaggcaggagaatcacttgaactcgggaggtggaggttgcagtgagccgagatcgcaccattgcactgggcaacaagagtgaaactccatctcaaaaaaagaaaacaa

SEQ ID NO: 4915 - DNA, 802 bp, synthetic construct
  misc_feature 1..802: note = Synthetic polypeptide
  source 1..802: mol_type = other DNA
atgggcggcctcttctggcgctccgcgctgcgggggctgcgctgcggcccgcgggccccgggcccgagcctgctagtgcgccacggctcgggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggagcagtggctcacgcctgtaatcccagctctttgggaggccgaagcgggtagatcaccagaggtcaggagttcgagaccagcctggccaacatggtgaaaccccgtctctgctaaaaatacaaaaaattagccgggtgtggtggcgcacacctgtaatcccaactacttgggaggctgaggcaggagaatcacttgaactcgggaggtggaggttgcagtgagccgagatcgcaccattgcactgggcaacaagagtgaaactccatctcaaaaaaagaaaacaa

SEQ ID NO: 4916 - DNA, 826 bp, synthetic construct
  misc_feature 1..826: note = Synthetic polypeptide
  source 1..826: mol_type = other DNA
atgggcggcctcttctggcgctccgcgctgcgggggctgcgctgcggcccgcgggccccgggcccgagcctgctagtgcgccacggctcggggctccctccatcggctctgaaaagagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggagcagtggctcacgcctgtaatcccagctctttgggaggccgaagcgggtagatcaccagaggtcaggagttcgagaccagcctggccaacatggtgaaaccccgtctctgctaaaaatacaaaaaattagccgggtgtggtggcgcacacctgtaatcccaactacttgggaggctgaggcaggagaatcacttgaactcgggaggtggaggttgcagtgagccgagatcgcaccattgcactgggcaacaagagtgaaactccatctcaaaaaaagaaaacaa

SEQ ID NO: 4917 - DNA, 797 bp, synthetic construct
  misc_feature 1..797: note = Synthetic polypeptide
  source 1..797: mol_type = other DNA
atggagcccaaagaagccactgggaaagaaaacatggtcaccaagaaaaagaatctggccttcttgaggtctagactctatatgctggagagaaggaagactgacactgtggttgagagcagtgtttctggggaccactctggcaccttgaggaggagccaatctgacaggactgaatacaaccagaaattacaagaaaagatgactccacagggtgagtgttctgtagctgagaccttaaccccagaggaagagcatcatatgaagaggatgatggcaaagcgggaaaagatcattaaggagctgatacagacagaaaaggattatctcaatgatctagagctgtgtgttagggaagtggttcagcccctgagaaataaaaagactgataggctggatgtggatagcttgtttagcaacattgagtccgtgcatcagatatcagccaagctgctgtcattgttggaagaggccacaacagacgtggaaccggccatgcaagtaattggagaagtattcttgcagattaaagggccactggaagatatttataaaatctactgctatcaccatgatgaagcacatagtatactggagtcctatgaaaaggaagaagagctgaaggaacatttgagccactgtatccagtccttaaagaaaatatacatgcaagagaatagaagaaactactgaaggatgtactctatcaaaatgaggaagaaccaacacaggaaagaggcaaagagaatctccaggatgatgggaggggaattcctacaagacggctgcacatctgg

SEQ ID NO: 4918 - DNA, 791 bp, synthetic construct
  misc_feature 1..791: note = Synthetic polypeptide
  source 1..791: mol_type = other DNA
atggagcccaaagaagccactgggaaagaaaacatggtcaccaagaaaaagaatctggccttcttgaggtctagactctatatgctggagagaaggaagactgacactgtggttgagagcagtgtttctggggaccactctggcaccttgaggaggagccaatctgacaggactgaatacaaccagaaattacaagaaaagatgactccacagggtgagtgttctgtagctgagaccttaaccccagaggaagagcatcatatgaagaggatgatggcaaagcgggaaaagatcattaaggagctgatacagacagaaaaggattatctcaatgatctagagctgtgtgttagggaagtggttcagcccctgagaaataaaaagactgataggctggatgtggatagcttgtttagcaacattgagtccgtgcatcagatatcagccaagctgctgtcattgttggaagaggccacaacagacgtggaaccggccatgcaagtaattggagaagtattcttgcagattaaagggccactggaagatatttataaaatctactgctatcaccatgatgaagcacatagtatactggagtcctatgaaaaggaagaagagctgaaggaacatttgagccactgtatccagtccttaaagaaaatatacatgcaagaaagaaactactgaaggatgtactctatcaaaatgaggaagaaccaacacaggaaagaggcaaagagaatctccaggatgatgggaggggaattcctacaagacggctgcacatctgg

SEQ ID NO: 4919 - DNA, 397 bp, synthetic construct
  misc_feature 1..397: note = Synthetic polypeptide
  source 1..397: mol_type = other DNA
atgaaaagaaatacctgtgatttgctttctcggagcaaaagttttctctttctccaatcactcactctggaggcagctagctgtcaactcacaaagacactcaagcagcctatggaagaaggccacatggtaaaatatggaggcctccagccaacagtcagcaaggaactgagacaagtcaacaaccatgtgagtgactcgagaagtgcttctctagctccagttgagacttgcagtagcagcagcctcagctggcggcttgactgcaatctcttgagagaccctaagctctcctgaattcttgatccttagaaactgtgtgaggtaagagatatttgttgctttaagatgctacatttggggataattcattacacagaaatagatatctcattca

SEQ ID NO: 4920 - DNA, 842 bp, synthetic construct
  misc_feature 1..842: note = Synthetic polypeptide
  source 1..842: mol_type = other DNA
atgaaaaatgccacgattgtaatgtctgtgaggagagagcaaggcagttcttcaggggaggggtcattgtcattcgaagatgtggctgtgggcttcaccagggaggagtggcagtttttggaccagtctcagaaggtcttgtacaaggaagtaatgttggagaactacatcaacctagtatcaatagggtatcgaggcaccaagccagattcgctcttcaagttggagcaaggagaacccccagggatagcagaaggagcagcccacagtcaaatctgtccagatctgcattaccgttggaaaacagcagcctcagaaccacagtagccatgaagaccatcagccttcaaccaccacccttgtatcagaggagacaaataagcttggaaatcctcaaaaagcctcatcctcagagcaatgtcattatatatcttgtcttacagctccatgatgtggttccattctttgtcctaactcattctctcacctgactcaaagctcactttgaaggaaaagtgcgatactagggcactggtcaaaaacgatcagcttcaattgtttaactttgtagtagcctaagcctgcagtaccgttagggagcaaacaagagctctgaaaaattgttaaacggacatctgaagaacaagatgttaatagggaactcttaaatactctgacatattcctgaggatctagaaggcccaacacatacacagggatgtgtgcatgcccatgagatacctgagggtaccagtagttcacttctagctgatcttgaagcccttgagaagaaggaagagaaggctaaagtagacttacaaactgcttgagcattgaagtag

SEQ ID NO: 4921 - DNA, 77 bp, synthetic construct; identical to SEQ ID NO: 1778
  misc_feature 1..77: note = Synthetic polypeptide
  source 1..77: mol_type = other DNA

SEQ ID NO: 4922 - DNA, 280 bp, synthetic construct
  misc_feature 1..280: note = Synthetic polypeptide
  source 1..280: mol_type = other DNA
atggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagttacatgtctggatactggctactggctactgtattggtcagcacag

SEQ ID NO: 4923 - DNA, 160 bp, synthetic construct
  misc_feature 1..160: note = Synthetic polypeptide
  source 1..160: mol_type = other DNA
atgcttcaagatttaagtgcaagtgtcttctttccaccttgttcacaacacagaacgttagctcaggtacctgacaatgatgagcagtttgtaccagactatcaggctgaaagttacatgtctggatactggctactggctactgtattggtcagcacag

SEQ ID NO: 4924 - DNA, 322 bp, synthetic construct
  misc_feature 1..322: note = Synthetic polypeptide
  source 1..322: mol_type = other DNA
atgagtggaagaggagatggagggcagcagcagctgctgcactcaaagtttttggctgggtttgtctgccacattgaaaagaatgaaagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagttacatgtctggatactggctactggctactgtattggtcagcacag

SEQ ID NO: 4925 - DNA, 2905 bp, synthetic construct
  misc_feature 1..2905: note = Synthetic polypeptide
  source 1..2905: mol_type = other DNA
atgatgagcttcggcggcgcggacgcgctgctgggcgccccgttcgcgccgctgcatggcggcggcagcctccactacgcgctagcccgaaagggtggcgcaggcgggacgcgctccgccgctggctcctccagcggcttccactcgtggacacggacgtccgtgagctccgtgtccgcctcgcccagccgcttccgtggcgcaggcgccgcctcaagcaccgactcgctggacacgctgagcaacgggccggagggctgcatggtggcggtggccacctcacgcagtgagaaggagcagctgcaggcgctgaacgaccgcttcgccgggtacatcgacaaggtgcggcagctggaggcgcacaaccgcagcctggagggcgaggctgcggcgctgcggcagcagcaggcgggccgctccgctatgggcgagctgtacgagcgcgaggtccgcgagatgcgcggcgcggtgctgcgcctgggcgcggcgcgcggtcagctacgcctggagcaggagcacctgctcgaggacatcgcgcacgtgcgccagcgcctagacgacgaggcccggcagcgagaggaggccgaggcggcggcccgcgcgctggcgcgcttcgcgcaggaggccgaggcggcgcgcgtggacctgcagaagaaggcgcaggcgctgcaggaggagtgcggctacctgcggcgccaccaccaggaagaggtgggcgagctgctcggccagatccagggctccggcgccgcgcaggcgcagatgcaggccgagacgcgcgacgccctgaagtgcgacgtgacgtcggcgctgcgcgagattcgcgcgcagcttgaaggccacgcggtgcagagcacgctgcagtccgaggagtggttccgagtgaggctggaccgactgtcggaggcagccaaggtgaacacagacgctatgcgctcagcgcaggaggagataactgagtaccggcgtcagctgcaggccaggaccacagagctggaggcactgaaaagcaccaaggactcactggagaggcagcgctctgagctggaggaccgtcatcaggccgacattgcctcctaccaggaagccattcagcagctggacgctgagctgaggaacaccaagtgggagatggccgcccagctgcgagaataccaggacctgctcaatgtcaagatggctctggatatagagatagccgcttacagaaaactcctggaaggtgaagagtgtcggattggctttggcccaattcctttctcgcttccagaaggactccccaaaattccctctgtgtccactcacataaaggtgaaaagcgaagagaagatcaaagtggtggagaagtctgagaaagaaactgtgattgtggaggaacagacagaggagacccaagtgactgaagaagtgactgaagaagaggagaaagaggccaaagaggaggagggcaaggaggaagaagggggtgaagaagaggaggcagaagggggagaagaagaaacaaagtctcccccagcagaagaggctgcatccccagagaaggaagccaagtcaccagtaaaggaagaggcaaagtcaccggctgaggccaagtccccagagaaggaggaagcaaaatccccagccgaagtcaagtcccctgagaaggccaagtctccagcaaaggaagaggcaaagtcaccgcctgaggccaagtccccagagaaggaggaagcaaaatctccagctgaggtcaagtcccccgagaaggccaagtccccagcaaaggaagaggcaaagtcaccggctgaggccaagtctccagagaaggccaagtccccagtgaaggaagaagcaaagtcaccggctgaggccaagtccccagtgaaggaagaagcaaaatctccagctgaggtcaagtccccggaaaaggccaagtctccaacgaaggaggaagcaaagtcccctgagaaggccaagtccccagagaaggaagaggccaagtcccctgagaaggccaagtccccagtgaaggcagaagcaaagtcccctgagaaggccaagtccccagtgaaggcagaagcaaagtcccctgagaaggccaagtccccagtgaaggaagaagcaaagtcccctgagaaggccaagtccccagtgaaggaagaagcaaagtcccctgagaaggccaagtccccagtgaaggaagaagcaaagacccccgagaaggccaagtccccagtgaaggaagaagctaagtccccagagaaggccaagtccccagagaaggccaagactcttgatgtgaagtctccagaagccaagactccagcgaaggaggaagcaaggtcccctgcagacaaattccctgaaaaggccaaaagccctgtcaaggaggaggtcaagtccccagagaaggcgaaatctcccctgaaggaggatgccaaggcccctgagaaggagatcccaaaaaaggaagaggtgaagtccccagtgaaggaggaggagaagccccaggaggtgaaagtcaaagagcccccaaagaaggcagaggaagagaaagcccctgccacaccaaaaacagaggagaagaaggacagcaagaaagaggaggcacccaagaaggaggctccaaagcccaaggtggaggagaagaaggaacctgctgtcgaaaagcccaaagaatccaaagttgaagccaagaaggaagaggctgaagataagaaaaaagtccccaccccagagaaggaggctcctgccaaggtggaggtgaaggaagacgctaaacccaaagaaaagacagaggaggccaagacgggagggtcacttgaacctggtaaggtggaggttgcagtgagctgagatcatgccactgtactccagcctacgcaacaaagcaagactccgtctcaaaataaataaataaaaa

SEQ ID NO: 4926 - DNA, 454 bp, synthetic construct
  misc_feature 1..454: note = Synthetic polypeptide
  source 1..454: mol_type = other DNA
atggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggctggagcaagaagaggacctgtgcagggcagagcaggaggccccccgagggaaaatgacatttgaagacaaagtcagacatctacaagccaaggaatgccagagattgccagcaaaccaccaaaaactaaggaaagggatggaacatatactttcttgtagccctcagaaggaaccaactatgccaacactttgatctcagacttctggcttccacaactgtaacaataaatttatgtcgtttaagccaccccatttgtggtatgttgttaccagagccctcatgactaataca

SEQ ID NO: 4927 - DNA, 489 bp, synthetic construct
  misc_feature 1..489: note = Synthetic polypeptide
  source 1..489: mol_type = other DNA
atggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggggcttttcctttccaaatctgatgtgatctctcagctggagcaagaagaggacctgtgcagggcagagcaggaggccccccgagggaaaatgacatttgaagacaaagtcagacatctacaagccaaggaatgccagagattgccagcaaaccaccaaaaactaaggaaagggatggaacatatactttcttgtagccctcagaaggaaccaactatgccaacactttgatctcagacttctggcttccacaactgtaacaataaatttatgtcgtttaagccaccccatttgtggtatgttgttaccagagccctcatgactaataca

SEQ ID NO: 4928 - DNA, 558 bp, synthetic construct; identical to SEQ ID NO: 2797
  misc_feature 1..558: note = Synthetic polypeptide
  source 1..558: mol_type = other DNA

SEQ ID NO: 4929 - DNA, 697 bp, synthetic construct
  misc_feature 1..697: note = Synthetic polypeptide
  source 1..697: mol_type = other DNA
atgcgcccattggctggtggcctgctcaaggtggtgttcgtggtcttcgcctccttgtgtgcctggtattcggggtacctgctcgcagagctcattccagatgcacccctgtccagtgctgcctatagcatccgcagcatcggggagaggcctgtcctcaaagctccagtccccaaaaggcaaaaatgtgaccactggactccctgcccatctgacacctatgcctacaggttactcagcggaggtggcagaagcaagtacgccaaaatctgctttgaggataacctacttatgggagaacagctgggaaatgttgccagaggaataaacattgccattgtcaactatgtaactgggaatgtgacagcaacacgatgttttgatatgtatgaaggtgataactctggaccgatgacaaagtttattcagagtgctgctccaaaatccctgctcttcatggtgacctatgacgacggaagcacaagactgaataacgatgccaagaatgccatagaagcacttggaagtaaagaaatcaggaacatgaaattcaggtctagctgggtatttattgcagcaaaaggcttggaactcccttccgaaattcagagagaaaaggatggctgagagcatgaacagacatggtgaatgcaaaacactcaaaacaggctggacaccaaatcaacactgcacaaat

SEQ ID NO: 4930 - DNA, 553 bp, synthetic construct
  misc_feature 1..553: note = Synthetic polypeptide
  source 1..553: mol_type = other DNA
atgcgcccattggctggtgctccagtccccaaaaggcaaaaatgtgaccactggactccctgcccatctgacacctatgcctacaggttactcagcggaggtggcagaagcaagtacgccaaaatctgctttgaggataacctacttatgggagaacagctgggaaatgttgccagaggaataaacattgccattgtcaactatgtaactgggaatgtgacagcaacacgatgttttgatatgtatgaaggtgataactctggaccgatgacaaagtttattcagagtgctgctccaaaatccctgctcttcatggtgacctatgacgacggaagcacaagactgaataacgatgccaagaatgccatagaagcacttggaagtaaagaaatcaggaacatgaaattcaggtctagctgggtatttattgcagcaaaaggcttggaactcccttccgaaattcagagagaaaaggatggctgagagcatgaacagacatggtgaatgcaaaacactcaaaacaggctggacaccaaatcaacactgcacaaat

SEQ ID NO: 4931 - DNA, 814 bp, synthetic construct
  misc_feature 1..814: note = Synthetic polypeptide
  source 1..814: mol_type = other DNA
atgcgcccattggctggtggttcacgttgggcatgctggctcacaaggtgcttgattagctgctttgacataaacgttcaaggacgtttgttggttaagttaagacctaaaccaacagcaaatacaacttgccctggcctgctcaaggtggtgttcgtggtcttcgcctccttgtgtgcctggtattcggggtacctgctcgcagagctcattccagatgcacccctgtccagtgctgcctatagcatccgcagcatcggggagaggcctgtcctcaaagctccagtccccaaaaggcaaaaatgtgaccactggactccctgcccatctgacacctatgcctacaggttactcagcggaggtggcagaagcaagtacgccaaaatctgctttgaggataacctacttatgggagaacagctgggaaatgttgccagaggaataaacattgccattgtcaactatgtaactgggaatgtgacagcaacacgatgttttgatatgtatgaaggtgataactctggaccgatgacaaagtttattcagagtgctgctccaaaatccctgctcttcatggtgacctatgacgacggaagcacaagactgaataacgatgccaagaatgccatagaagcacttggaagtaaagaaatcaggaacatgaaattcaggtctagctgggtatttattgcagcaaaaggcttggaactcccttccgaaattcagagagaaaaggatggctgagagcatgaacagacatggtgaatgcaaaacactcaaaacaggctggacaccaaatcaacactgcacaaat

SEQ ID NO: 4932 - DNA, 766 bp, synthetic construct
  misc_feature 1..766: note = Synthetic polypeptide
  source 1..766: mol_type = other DNA
atgaaaagccacaggggggatggggagggccaagggccagggccgccaccaagtcgttcacagcagctgcttggtgtcctctctgcaggcctgctcaaggtggtgttcgtggtcttcgcctccttgtgtgcctggtattcggggtacctgctcgcagagctcattccagatgcacccctgtccagtgctgcctatagcatccgcagcatcggggagaggcctgtcctcaaagctccagtccccaaaaggcaaaaatgtgaccactggactccctgcccatctgacacctatgcctacaggttactcagcggaggtggcagaagcaagtacgccaaaatctgctttgaggataacctacttatgggagaacagctgggaaatgttgccagaggaataaacattgccattgtcaactatgtaactgggaatgtgacagcaacacgatgttttgatatgtatgaaggtgataactctggaccgatgacaaagtttattcagagtgctgctccaaaatccctgctcttcatggtgacctatgacgacggaagcacaagactgaataacgatgccaagaatgccatagaagcacttggaagtaaagaaatcaggaacatgaaattcaggtctagctgggtatttattgcagcaaaaggcttggaactcccttccgaaattcagagagaaaaggatggctgagagcatgaacagacatggtgaatgcaaaacactcaaaacaggctggacaccaaatcaacactgcacaaat

SEQ ID NO: 4933 - DNA, 225 bp, synthetic construct
  misc_feature 1..225: note = Synthetic polypeptide
  source 1..225: mol_type = other DNA
atgccggcggtcagtggtccaggtcccttattctgccttctcctcctgctcctggacccccacagccctgagacggggtgtcctcctctacgcaggtttgagtacaagctcagcttcaaaggcccaaggctggcattgcctggggctggaatacccttctggagccatcatggagatggggtcttataaaaacagacagcacacactgcggtgaggcttcactga

SEQ ID NO: 4934 - DNA, 3611 bp, synthetic construct
  misc_feature 1..3611: note = Synthetic polypeptide
  source 1..3611: mol_type = other DNA
atgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagccatcaccgatgattcctccaggtactgtaaaatctgaggcaactagcgattggagtcgaccccccagcacaacacagcagccctgcagaaaagtggctagactgtttaaaaaaaaaaaaaagaaaagaaaaaaaaggacaagctccactcaaaggtcaccaacctcaaagattgaaggcagataagcccacaaagatgagaaaggatcagtacaagaacattgaaaactcaaaatgccacagtgccctctttcctccaaatgactgcatcacttctccagcaaggtttcggaaccgggttgaggctgagatgcctgaaatgacagaagtagaattcataatatggatagggacaaagtttactgaggtaaaggagcgtgttgtaacccaattctaggaagctaaaaatcatgttaaaacattgcaggaactgacagtaaaatgagccagtttagagaagaatagagctgaaaaatactacaaatgctgtcacaagtattgatagcagtatagaccaagtgaaggaaagaatcttagagttgaagactgtctttctgaaataatacaggcagacaagaatagagaaaaaggaatgaacaaaaccaccaagaaatatgtgattatgtgaagagactgaatctatgactgattggtgtacttgaaagagataggaagaatggaaccagcttggaaaacatattccaggatataatccatgagaactttcccaacatagctagataggccaacattcaaattcaggaaatgcagagaacctcagtaagatactacttgagaagatcatccccaagacacatactcatcagattctccaaggacaaaatgagagaaaaaatgttaaaggcagctagagggaaaggccaggttacctacaaagggaagcccatcagcctaacagtggacctctcagctgaaaccctgcaagccagaagagattggaggccaatgttcaacattcttagaaaaaagaaattccaatccagaatttcatatccgaccacattaagctttatacgtgaaggagaaataagattctttcaagacaagcaaatgctgagggaatttgttaccaccagacctgtcttaacaagagttattgagagaagtactaaatatggacaggaaagactatcaccatccacgacaaaaacacactgaagtacacagaccagtgatactataaagcaatcacataagtctgcagaataaccagctaacatcatgatgacaggatcaaatccacacatttcaattctaatcttatatgtaaatggtctaaatacaccaattaaaatacatagagtggcaagctggataaagaaccaggacctattggtatcctgtcttcaagagacccttctcatatgcaatgacacacataagtcaaaataaatagatgaaggaaagtctaccaagcaaatagaaaacagaaaaatgcaggagttgcaattctagtttctgacaaaacagactttaaaccaacaaagataaaaaaaaagacaaagaagggcatcacgtaacggtaaaggattcaattcaacaagaagagcttactgtcctaaatatatatgcacataacacaggagcacccagattcataaggcaagttcttagagaccttcaaagagacttagactcccacacaataatagtggtagactttaacagcctattgaaaatattaattaattttcaagacataaaataacaaagatattcatggcctaaactgagtactggatcaaatggacctgatagatatctacaaaattctccacccagaaacaacagaatagacattcttctcatcagcccatggcacttactctaaaattgatcacataattggaagtaaaacactcctcagcaaaagcaaaagaaatgaaattaaaaacgtctcttgtactgccgtgcaaattcaaaatcaagagtaagaaattcactcaaaactatgcaattccatggaaattgaataacctgctcctgaatgacttgtgggtatataatgagataaaagcaggaatcaagaagttctttgaaactaatgagaacaaagatatgacacaccagaatctctgggacacagctaaggcagaattaaaagggaaatttatagcactaaatgcccacattaaaagttagaaatatct

SEQ ID NO: 4935 - DNA, 2687 bp, synthetic construct
  misc_feature 1..2687: note = Synthetic polypeptide
  source 1..2687: mol_type = other DNA
atgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagccatcaccgatgattcctccaggtactgtaaaatctgaggcaactagcgattggagtcgaccccccagcacaacacagcagccctgcagaaaagtggctagactgtttaaaaaaaaaaaaaagaaaagaaaaaaaaggacaagctccactcaaaggtcaccaacctcaaagattgaaggcagataagcccacaaagatgagaaaggatcagtacaagaacattgaaaactcaaaatgccacagtgccctctttcctccaaatgactgcatcacttctccagcaaggtttcggaaccgggttgaggctgagatgcctgaaatgacagaagtagaattcataatatggatagggacaaagtttactgaggtaaaggagcgtgttgtaacccaattctaggaagctaaaaatcatgttaaaacattgcaggaactgacagtaaaatgagccagtttagagaagaatagagctgaaaaatactacaaatgctgtcacaagtattgatagcagtatagaccaagtgaaggaaagaatcttagagttgaagactgtctttctgaaataatacaggcagacaagaatagagaaaaaggaatgaacaaaaccaccaagaaatatgtgattatgtgaagagactgaatctatgactgattggtgtacttgaaagagataggaagaatggaaccagcttggaaaacatattccaggatataatccatgagaactttcccaacatagctagataggccaacattcaaattcaggaaatgcagagaacctcagtaagatactacttgagaagatcatccccaagacacatactcatcagattctccaaggacaaaatgagagaaaaaatgttaaaggcagctagagggaaaggccaggttacctacaaagggaagcccatcagcctaacagtggacctctcagctgaaaccctgcaagccagaagagattggaggccaatgttcaacattcttagaaaaaagaaattccaatccagaatttcatatccgaccacattaagctttatacgtgaaggagaaataagattctttcaagacaagcaaatgctgagggaatttgttaccaccagacctgtcttaacaagagttattgagagaagtactaaatatggacaggaaagactatcaccatccacgacaaaaacacactgaagtacacagaccagtgatactataaagcaatcacataagtctgcagaataaccagctaacatcatgatgacaggatcaaatccacacatttcaattctaatcttatatgtaaatggtctaaatacaccaattaaaatacatagagtggcaagctggataaagaaccaggacctattggtatcctgtcttcaagagacccttctcatatgcaatgacacacataagtcaaaataaatagatgaaggaaagtctaccaagcaaatagaaaacagaaaaatgcaggagttgcaattctagtttctgacaaaacagactttaaaccaacaaagataaaaaaaaagacaaagaagggcatcacgtaacggtaaaggattcaattcaacaagaagagcttactgtcctaaatatatatgcacataacacaggagcacccagattcataaggcaagttcttagagaccttcaaagagacttagactcccacacaataatagtggtagactttaacagcctattgaaaatattaattaattttcaagacataaaataacaaagatattcatggcctaaactgagtactggatcaaatggacctgatagatatctacaaaattctccacccagaaacaacagaatagacattcttctcatcagcccatggcacttactctaaaattgatcacataattggaagtaaaacactcctcagcaaaagcaaaagaaatgaaattaaaaacgtctcttgtactgccgtgcaaattcaaaatcaagagtaagaaattcactcaaaactatgcaattccatggaaattgaataacctgctcctgaatgacttgtgggtatataatgagataaaagcaggaatcaagaagttctttgaaactaatgagaacaaagatatgacacaccagaatctctgggacacagctaaggcagaattaaaagggaaatttatagcactaaatgcccacattaaaagttagaaatatct

SEQ ID NO: 4936 - DNA, 3566 bp, synthetic construct
  misc_feature 1..3566: note = Synthetic polypeptide
  source 1..3566: mol_type = other DNA
atgactgcaggatctagctatccattgtttctggccgcctatgcgtgcactgggtgtctggcagagaggctggggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagccatcaccgatgattcctccaggtactgtaaaatctgaggcaactagcgattggagtcgaccccccagcacaacacagcagccctgcagaaaagtggctagactgtttaaaaaaaaaaaaaagaaaagaaaaaaaaggacaagctccactcaaaggtcaccaacctcaaagattgaaggcagataagcccacaaagatgagaaaggatcagtacaagaacattgaaaactcaaaatgccacagtgccctctttcctccaaatgactgcatcacttctccagcaaggtttcggaaccgggttgaggctgagatgcctgaaatgacagaagtagaattcataatatggatagggacaaagtttactgaggtaaaggagcgtgttgtaacccaattctaggaagctaaaaatcatgttaaaacattgcaggaactgacagtaaaatgagccagtttagagaagaatagagctgaaaaatactacaaatgctgtcacaagtattgatagcagtatagaccaagtgaaggaaagaatcttagagttgaagactgtctttctgaaataatacaggcagacaagaatagagaaaaaggaatgaacaaaaccaccaagaaatatgtgattatgtgaagagactgaatctatgactgattggtgtacttgaaagagataggaagaatggaaccagcttggaaaacatattccaggatataatccatgagaactttcccaacatagctagataggccaacattcaaattcaggaaatgcagagaacctcagtaagatactacttgagaagatcatccccaagacacatactcatcagattctccaaggacaaaatgagagaaaaaatgttaaaggcagctagagggaaaggccaggttacctacaaagggaagcccatcagcctaacagtggacctctcagctgaaaccctgcaagccagaagagattggaggccaatgttcaacattcttagaaaaaagaaattccaatccagaatttcatatccgaccacattaagctttatacgtgaaggagaaataagattctttcaagacaagcaaatgctgagggaatttgttaccaccagacctgtcttaacaagagttattgagagaagtactaaatatggacaggaaagactatcaccatccacgacaaaaacacactgaagtacacagaccagtgatactataaagcaatcacataagtctgcagaataaccagctaacatcatgatgacaggatcaaatccacacatttcaattctaatcttatatgtaaatggtctaaatacaccaattaaaatacatagagtggcaagctggataaagaaccaggacctattggtatcctgtcttcaagagacccttctcatatgcaatgacacacataagtcaaaataaatagatgaaggaaagtctaccaagcaaatagaaaacagaaaaatgcaggagttgcaattctagtttctgacaaaacagactttaaaccaacaaagataaaaaaaaagacaaagaagggcatcacgtaacggtaaaggattcaattcaacaagaagagcttactgtcctaaatatatatgcacataacacaggagcacccagattcataaggcaagttcttagagaccttcaaagagacttagactcccacacaataatagtggtagactttaacagcctattgaaaatattaattaattttcaagacataaaataacaaagatattcatggcctaaactgagtactggatcaaatggacctgatagatatctacaaaattctccacccagaaacaacagaatagacattcttctcatcagcccatggcacttactctaaaattgatcacataattggaagtaaaacactcctcagcaaaagcaaaagaaatgaaattaaaaacgtctcttgtactgccgtgcaaattcaaaatcaagagtaagaaattcactcaaaactatgcaattccatggaaattgaataacctgctcctgaatgacttgtgggtatataatgagataaaagcaggaatcaagaagttctttgaaactaatgagaacaaagatatgacacaccagaatctctgggacacagctaaggcagaattaaaagggaaatttatagcactaaatgcccacattaaaagttagaaatatct

SEQ ID NO: 4937 - DNA, 3765 bp, synthetic construct
  misc_feature 1..3765: note = Synthetic polypeptide
  source 1..3765: mol_type = other DNA
atgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatgttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttatcatcttctctccaggggctctggaccatccgggcatacaaagcagaagagaggtgtcaggaactgtttgatgcacaccaggatttacattcagaggcttggttcttgtttttgacaacgtcccgctggtttgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtggaagtgatgattggatcattggagcggcttccc

SEQ ID NO: 4938 - DNA, 3906 bp, synthetic construct
  misc_feature 1..3906: note = Synthetic polypeptide
  source 1..3906: mol_type = other DNA
atgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttatcatcttctctccaggggctctggaccatccgggcatacaaagcagaagagaggtgtcaggaactgtttgatgcacaccaggatttacattcagaggcttggttcttgtttttgacaacgtcccgctggtttgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtggaagtgatgattggatcattggagcggcttccc

SEQ ID NO: 4939 - DNA, 1108 bp, synthetic construct
  misc_feature 1..1108: note = Synthetic polypeptide
  source 1..1108: mol_type = other DNA
atgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaagttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaaga

SEQ ID NO: 4940 - DNA, 1333 bp, synthetic construct
  misc_feature 1..1333: note = Synthetic polypeptide
  source 1..1333: mol_type = other DNA
atgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaatggcaccctcctgtcgggcgccaaagtggccgccgcggcggggctggcggtggagcgggaaggccggctgggggagaagccggcaccggtgccgccacccggagaggacgccttgagaagcggcggggctgcccccagcgagccgggcagcggtggcaaggcggggagaggccgctggcggacggtgcagagccacctggccgcagggaagctcaacttgtccaagttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaaga

SEQ ID NO: 4941 - DNA, 1957 bp, synthetic construct
  misc_feature 1..1957: note = Synthetic polypeptide
  source 1..1957: mol_type = other DNA
atgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaatgatctagacagagacttttggaataacaatgagagcacagtgcagcagaaatggagctcctaccctcccaaggagtttattctaaacatttcaccctacgccccttatggcgacccacgactgtccctcaatggcaccctcctgtcgggcgccaaagtggccgccgcggcggggctggcggtggagcgggaaggccggctgggggagaagccggcaccggtgccgccacccggagaggacgccttgagaagcggcggggctgcccccagcgagccgggcagcggtggcaaggcggggagaggccgctggcggacggtgcagagccacctggccgcagggaagctcaacttgtccaatttcgaggactccaccctgtccacggccactacccttgagtctatccccagctccacgggagagccgaaatgccagcgaccccgcaccctgatgcggcagcagagcctgcaacagccgctgagccagcaccagcggggccggcagcccagccagcccaccaccagccagagcctgggccagctgcaggcccacatggcctcggcaccaggccccaacccccgggcctatggccggggccaggctcggcagggcacctcggccggctccaagtaccgggcggcagggggccgcagccgctccaacccaggcagctgggaccacgtggtggggcagattcgaaaccgaggcttggacatgaaatccttcctggaaggccggatggtggtgctatccttggtcttagggctttcggaacaggatgactttgccaatatccctgacctgcaaaacccaggaacccagcagaaccagaacgctcagggggacaagaggttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaaga

SEQ ID NO: 4942 - DNA, 1240 bp, synthetic construct
  misc_feature 1..1240: note = Synthetic polypeptide
  source 1..1240: mol_type = other DNA
atgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaatgatctagacagagacttttggaataacaatgagagcacagtgcagcagaaatggagctcctaccctcccaaggagtttattctaaacatttcaccctacgccccttatggcgacccacgactgtccctcaagttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaaga

SEQ ID NO: 4943 - DNA, 1732 bp, synthetic construct
  misc_feature 1..1732: note = Synthetic polypeptide
  source 1..1732: mol_type = other DNA
atgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaatgatctagacagagacttttggaataacaatgagagcacagtgcagcagaaatggagctcctaccctcccaaggagtttattctaaacatttcaccctacgccccttatggcgacccacgactgtccctcaatttcgaggactccaccctgtccacggccactacccttgagtctatccccagctccacgggagagccgaaatgccagcgaccccgcaccctgatgcggcagcagagcctgcaacagccgctgagccagcaccagcggggccggcagcccagccagcccaccaccagccagagcctgggccagctgcaggcccacatggcctcggcaccaggccccaacccccgggcctatggccggggccaggctcggcagggcacctcggccggctccaagtaccgggcggcagggggccgcagccgctccaacccaggcagctgggaccacgtggtggggcagattcgaaaccgaggcttggacatgaaatccttcctggaaggccggatggtggtgctatccttggtcttagggctttcggaacaggatgactttgccaatatccctgacctgcaaaacccaggaacccagcagaaccagaacgctcagggggacaagaggttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaaga

SEQ ID NO: 4944 - DNA, 1465 bp, synthetic construct
  misc_feature 1..1465: note = Synthetic polypeptide
  source 1..1465: mol_type = other DNA
atgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaatgatctagacagagacttttggaataacaatgagagcacagtgcagcagaaatggagctcctaccctcccaaggagtttattctaaacatttcaccctacgccccttatggcgacccacgactgtccctcaatggcaccctcctgtcgggcgccaaagtggccgccgcggcggggctggcggtggagcgggaaggccggctgggggagaagccggcaccggtgccgccacccggagaggacgccttgagaagcggcggggctgcccccagcgagccgggcagcggtggcaaggcggggagaggccgctggcggacggtgcagagccacctggccgcagggaagctcaacttgtccaagttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaaga

SEQ ID NO: 4945 - DNA, 1808 bp, synthetic construct
  misc_feature 1..1808: note = Synthetic polypeptide
  source 1..1808: mol_type = other DNA
atggtgccacccaaattgcatgtgcttttctgcctctgcggctgcctggctgtggtttatccttttgactggcaatacataaatcctgttgcccatatgaaatcatcagcatgggtcaacaaaatacaagtactgatggctgctgcaagctttggccaaactaaaatcccccggggaaatgggccttattccgttggttgtacagacttaatgtttgatcacactaataagggcaccttcttgcgtttatattatccatcccaagataatgatcgccttgacaccctttggatcccaaataaagaatatttttggggtcttagcaaatttcttggaacacactggcttatgggcaacattttgaggttactctttggttcaatgacaactcctgcaaactggaattcccctctgaggcctggtgaaaaatatccacttgttgttttttctcatggtcttggggcattcaggacactttattctgctattggcattgacctggcatctcatgggtttatagttgctgctgtagaacacagagatagatctgcatctgcaacttactatttcaaggaccaatctgctgcagaaataggggacaagtcttggctctaccttagaaccctgaaacaagaggaggagacacatatacgaaatgagcaggtacggcaaagagcaaaagaatgttcccaagctctcagtctgattcttgacattgatcatggaaagccagtgaagaatgcattagatttaaagtttgatatggaacaactgaaggactctattgatagggaaaaaatagcagtaattggacattcttttggtggagcaacggttattcagactcttagtgaagatcagagattcagatgtggtattgccctggatgcatggatgtttccactgggtgatgaagtatattccagaattcctcagcccctcttttttatcaactctgaatatttccaatatcctgctaatatcataaaaatgaaaaaatgctactcacctgataaagaaagaaagatgattacaatcaggggttcagtccaccagaattttgctgacttcacttttgcaactggcaaaataattggacacatgctcaaattaaagggagacatagattcaaatgtagctattgatcttagcaacaaagcttcattagcattcttacaaaagcatttagaactgtgtggtggagcagaggctgagagaaaaatactgtctggctaggtgaccagaaaaaggggccattggaggctggataagagaggatcctgggagccagaaaatgtggaggacatctcagagaggaaaggagttgaaaatgtttaactcctaatgctacatgtgaactctaagtctcaggattgcccctgagctatgcacatgcagaacagagccaaataagcacagcaaagtctttgacacttaactactatataaaccactgaccaaagtccctgactaccctgggtggcttatgtacctggaagacctgaacaacaaaggctttgaaaactaaactgacaggacaatcaccaaccacagaaggagaaagagaacatgtaggatgaattgaaaccagctgatcatctgctgtaacaaaaacttcaacattctccagattttaacaggacccaatgtcttaaaacataatatgcaaaatgttcaggatataatccaaaattactcaacatacaaagaaccaagaaaagctgaccatttctctagggaaaagaaaatcaacagctacaaaccccaagatgaccagatattaaaactatcagacaaagattgtgaag

SEQ ID NO: 4946 - DNA, 458 bp, synthetic construct
  misc_feature 1..458: note = Synthetic polypeptide
  source 1..458: mol_type = other DNA
atggccaagtatggagaacatgaagccagtcctgacaatgggcagaacgaattcagtgatatcattaagtccagatctgccctctcctactacaggagagagagataatggccctttgctcctcattccgcattcagaccagattccccagctgcaatctcctgccatcggattgcatcaccaactcaacctaattggtgagatgtcactccctccctccaccgctcactctcatttctcagtgagtttagctctgtcactctctctaaaagttactcttgttttagtgatttgggtgtaaacattgatgatccttctaatactctgtcctcttaatttctctaagttctctttctagtgatcttgtctcccagtgtggtgggtatattctggctagaccaggtcattgtttatggtggcagcccctctgtcatctgaatttaagcgtcccatttttt

SEQ ID NO: 4947 - DNA, 377 bp, synthetic construct; identical to SEQ ID NO: 299
  misc_feature 1..377: note = Synthetic polypeptide
  source 1..377: mol_type = other DNA

SEQ ID NO: 4948 - DNA, 377 bp, synthetic construct; identical to SEQ ID NO: 300
  misc_feature 1..377: note = Synthetic polypeptide
  source 1..377: mol_type = other DNA

SEQ ID NO: 4949 - DNA, 1420 bp, synthetic construct
  misc_feature 1..1420: note = Synthetic polypeptide
  source 1..1420: mol_type = other DNA
atggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactgacttgattattcttagaaatgcacttgacctgcttttgccaaagcttgccagagtgatctctcggcttgccgactttgctaaggaacgagccagtctacccacattaggtttcacacatttccagcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagatttgcaccgacatacgcctcctggcaaacctcaaggagatggaggaaccctttgaaaaacagcagattggctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccgacggatctgtttggccgaggcatttcttaccgcagatactatattgaatacgctgcagaacatttctgaaggattggtcgtgtaccccaaagtaattgaacggcgcattcggcaagagctgcctttcatggccacagagaacatcatcatggccatggtcaaagctggaggtagccgccaggattgccatgagaaaatcagagtgctttctcagcaggcagcttctgtggttaagcaggaagggggtgacaatgacctcatagagcgtatccaggttgatgcctacttcagtcccattcactcccagttggatcatttactggatccttcttctttcactggtcgtgcctcccagcagggcagatgattctggaccagatgaagcctgaggagccttccagctctaagat

SEQ ID NO: 4950 - DNA, 1462 bp, synthetic construct
  misc_feature 1..1462: note = Synthetic polypeptide
  source 1..1462: mol_type = other DNA
atggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactagtctcattctgtcaaggggcgtgatcaaggcttattgcaacctccgcctcccaggctcagacagctctcctgtctcagtctcccaacttgccagagtgatctctcggcttgccgactttgctaaggaacgagccagtctacccacattaggtttcacacatttccagcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagatttgcaccgacatacgcctcctggcaaacctcaaggagatggaggaaccctttgaaaaacagcagattggctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccgacggatctgtttggccgaggcatttcttaccgcagatactatattgaatacgctgcagaacatttctgaaggattggtcgtgtaccccaaagtaattgaacggcgcattcggcaagagctgcctttcatggccacagagaacatcatcatggccatggtcaaagctggaggtagccgccaggattgccatgagaaaatcagagtgctttctcagcaggcagcttctgtggttaagcaggaagggggtgacaatgacctcatagagcgtatccaggttgatgcctacttcagtcccattcactcccagttggatcatttactggatccttcttctttcactggtcgtgcctcccagcagggcagatgattctggaccagatgaagcctgaggagccttccagctctaagat

SEQ ID NO: 4951 - DNA, 70 bp, synthetic construct
  misc_feature 1..70: note = Synthetic polypeptide
  source 1..70: mol_type = other DNA
ggtcgtgcctcccagcagggcagatgattctggaccagatgaagcctgaggagccttccagctctaagat

SEQ ID NO: 4952 - DNA, 451 bp, synthetic construct; identical to SEQ ID NO: 339
  misc_feature 1..451: note = Synthetic polypeptide
  source 1..451: mol_type = other DNA

SEQ ID NO: 4953 - DNA, 1300 bp, synthetic construct
  misc_feature 1..1300: note = Synthetic polypeptide
  source 1..1300: mol_type = other DNA
atgagccgcagcctggactcggcgcggagcttcctggagcggctggaagcgcggggcggccgggagggggcagtcctcgccggcgagttcagcgacatccaggcctgctcggccgcctggaaggctgacggcgtgtgctccaccgtggccggcagtcggccagagaacgtgaggaagaaccgctacaaagacgtgctgccttatgatcagacgcgagtaatcctctccctgctccaggaagagggacacagcgactacattaatggcaacttcatccggggcgtggatggaagcctggcctacattgccacgcaaggacccttgcctcacaccctgctagacttctggagactggtctgggagtttggggtcaaggtgatcctgatggcctgtcgagagatagagaatgggcggaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcagtgcgggttgtgggcgaacaggcgtcctgtgcaccgtggattatgtgaggcagctgctcctgacccagatgatcccacctgacttcagtctctttgatgtggtccttaagatgaggaagcagcggcctgcggccgtgcagacagaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcaggtggctcacccctgtaatcccagcacttcgggaggccaaggagggcggatcacttgagcccagctggagaccagcctggttaacatggtgaaaccctgtctctactaaaaatacaaaaattagccaggcgtgctggtgagagcctgtaatcccagctactccggaggctgaggcaggagagtcgcttgagcccgggaggtggaggttgcagtaagccgagatcgcaccacggcagtccagcctgggcgacagagcgagatcctgtctcaaaaaaacaacaaaaaaaa

SEQ ID NO: 4954 - DNA, 979 bp, synthetic construct
  misc_feature 1..979: note = Synthetic polypeptide
  source 1..979: mol_type = other DNA
atgagccgcagcctggactcggcgcggagcttcctggagcggctggaagcgcggggcggccgggagggggcagtcctcgccggcgagttcagcaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcagtgcgggttgtgggcgaacaggcgtcctgtgcaccgtggattatgtgaggcagctgctcctgacccagatgatcccacctgacttcagtctctttgatgtggtccttaagatgaggaagcagcggcctgcggccgtgcagacagaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcaggtggctcacccctgtaatcccagcacttcgggaggccaaggagggcggatcacttgagcccagctggagaccagcctggttaacatggtgaaaccctgtctctactaaaaatacaaaaattagccaggcgtgctggtgagagcctgtaatcccagctactccggaggctgaggcaggagagtcgcttgagcccgggaggtggaggttgcagtaagccgagatcgcaccacggcagtccagcctgggcgacagagcgagatcctgtctcaaaaaaacaacaaaaaaaa

SEQ ID NO: 4955 - DNA, 713 bp, synthetic construct
  misc_feature 1..713: note = Synthetic polypeptide
  source 1..713: mol_type = other DNA
agaccgtggggtccccagcagtcctgaccacatgctcgccatggtggaggaagcccgtcgcctccagggatctggccctgaacccctctgtgtccactgcagtgcgggttgtgggcgaacaggcgtcctgtgcaccgtggattatgtgaggcagctgctcctgacccagatgatcccacctgacttcagtctctttgatgtggtccttaagatgaggaagcagcggcctgcggccgtgcagacagaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcaggtggctcacccctgtaatcccagcacttcgggaggccaaggagggcggatcacttgagcccagctggagaccagcctggttaacatggtgaaaccctgtctctactaaaaatacaaaaattagccaggcgtgctggtgagagcctgtaatcccagctactccggaggctgaggcaggagagtcgcttgagcccgggaggtggaggttgcagtaagccgagatcgcaccacggcagtccagcctgggcgacagagcgagatcctgtctcaaaaaaacaacaaaaaaaa

SEQ ID NO: 4956 - DNA, 572 bp, synthetic construct; identical to SEQ ID NO: 159
  misc_feature 1..572: note = Synthetic polypeptide
  source 1..572: mol_type = other DNA

SEQ ID NO: 4957 - DNA, 475 bp, synthetic construct
  misc_feature 1..475: note = Synthetic polypeptide
  source 1..475: mol_type = other DNA
atgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagccatagcactcgcagagaaatatggatcactgg

SEQ ID NO: 4958 - DNA, 1502 bp, synthetic construct
  misc_feature 1..1502: note = Synthetic polypeptide
  source 1..1502: mol_type = other DNA
atggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgctgcccaacatgtttgggaacctgcgctccacgttaatggccctcatgattggctcttacgcctcttctgccattacgttcccaggaatcaagctgatctacgatgccggtgtggccttcgtggtcatcatgttcacctggtctggcctggcctgccttatctttctgaactgcaccctcaactggcccatcgaagcctttcctgcccctgaggaagtcaattacacgaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgagaggtctgtccccttacgcaagagcctctgctcccccactttcctgtggagcctcctcaccatgggcatgacccagctgcggatcatcttctacatggctgctgtgaacaagatgctggagtaccttgtgactggtggccaggagcatgagacaaatgaacagcaacaaaaggtggcagagacagttgggttctactcctccgtcttcggggccatgcagctgttgtgccttctcacctgccccctcattggctacatcatggactggcggatcaaggactgcgtggacgccccaactcagggcactgtcctcggagatgccagggacggggttgctaccaaatccatcagaccacgctactgcaagatccaaaagctcaccaatgccatcagtgccttcaccctgaccaacctgctgcttgtgggttttggcatcacctgtctcatcaacaacttacacctccagtttgtgacctttgtcctgcacaccattgttcgaggtttcttccactcagcctgtgggagtctctatgctgcagtgaatctgttgacttgcttgatcgtggtatctccagcacctagagcagtgcctggcacatagtaggttctcagctaaatgtttgttgacagaat

SEQ ID NO: 4959 - DNA, 610 bp, synthetic construct
  misc_feature 1..610: note = Synthetic polypeptide
  source 1..610: mol_type = other DNA
caccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgggacggggttgctaccaaatccatcagaccacgctactgcaagatccaaaagctcaccaatgccatcagtgccttcaccctgaccaacctgctgcttgtgggttttggcatcacctgtctcatcaacaacttacacctccagtttgtgacctttgtcctgcacaccattgttcgaggtttcttccactcagcctgtgggagtctctatgctgcagtgaatctgttgacttgcttgatcgtggtatctccagcacctagagcagtgcctggcacatagtaggttctcagctaaatgtttgttgacagaat

SEQ ID NO: 4960 - DNA, 651 bp, synthetic construct
  misc_feature 1..651: note = Synthetic polypeptide
  source 1..651: mol_type = other DNA
atggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccaggccgtgcgtggtggctcacacgtgtaattccaacactttgggaggccgaggtgggcggatcacctgaggtcgggagttccaggccaacctgaccaacatggagaaaccccgtctctactaaaaatacaaaattagccgggcgtggtggcgcatgcctgtaatcccagctactcgggaggctgaggcaggagaattgcttgaacccaggaggcggagtttgcagtgagctgagattgcgccattgcactccagcctgggtgggcaacaagagcaaaactctgtctcaaaaaaaaaaaccaaaaaaaaaaaa

SEQ ID NO: 4961 - DNA, 699 bp, synthetic construct
  misc_feature 1..699: note = Synthetic polypeptide
  source 1..699: mol_type = other DNA
atgcggatccctgagtgggtggctggctccccggtcttcacccctcagatgcaccgatctacccccgtctgtcctcttggcctccagaggtgtcctggccactggaggggcaggggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccaggccgtgcgtggtggctcacacgtgtaattccaacactttgggaggccgaggtgggcggatcacctgaggtcgggagttccaggccaacctgaccaacatggagaaaccccgtctctactaaaaatacaaaattagccgggcgtggtggcgcatgcctgtaatcccagctactcgggaggctgaggcaggagaattgcttgaacccaggaggcggagtttgcagtgagctgagattgcgccattgcactccagcctgggtgggcaacaagagcaaaactctgtctcaaaaaaaaaaaccaaaaaaaaaaaa

SEQ ID NO: 4962 - DNA, 1279 bp, synthetic construct
  misc_feature 1..1279: note = Synthetic polypeptide
  source 1..1279: mol_type = other DNA
atgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggtgctgcccctggaattcccagaacatcaacatcagctcccgtcctcatcaaagggtggaaaaaaggaaagcttgaaccagcttgggaaggaccttatctagtgctcctggccactgaaactgcatccgaacagcaaaaaaaggatgaactcatcatactcgagtgaaaaaacatcaccacctccggagtcacgggctactgttccaggggaaagtgctacctaactaaagctaagaaaaacccaaccctcct

SEQ ID NO: 4963 - DNA, 742 bp, synthetic construct
  misc_feature 1..742: note = Synthetic polypeptide
  source 1..742: mol_type = other DNA
atgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggtgctgcccctggaattcccagaacatcaacatcagctcccgtcctcatcaaagggtggaaaaaaggaaagcttgaaccagcttgggaaggaccttatctagtgctcctggccactgaaactgcatccgaacagcaaaaaaaggatgaactcatcatactcgagtgaaaaaacatcaccacctccggagtcacgggctactgttccaggggaaagtgctacctaactaaagctaagaaaaacccaaccctcct

SEQ ID NO: 4964 - DNA, 700 bp, synthetic construct
  misc_feature 1..700: note = Synthetic polypeptide
  source 1..700: mol_type = other DNA
atggccccggccgccgccagccccccggaggtgatccgcgcggcgcagaaggacgagtactaccgcggtgggctgcggagcgcggcgggcggcgccctgcacagcctggcgggtgcgaggaagtggctggagtggaggaaggaggttgagctgctctcagatgtggcctactttggcctcaccacacttgcaggctaccagaccctgggggaggagtacgtcagcatcatccaggtggacccatcgcggatacatgtgccctcctcgctgcgccgtggcgtgctggtgacactgcatgccgtcctgccctacctgctggacaaggccctgctccccctggagcaggagctgcaggctgaccccgacagtgggcgacccttgcaggggagcctggggccaggtgggcgtggctgctcaggggcgcggcgctggatgcgtcaccacacggccaccctgactgagcagcagaggagggcgctgctgcgggcggtcttcgtcctcagacagggcctcgcctgcctccagcggctacatgttgcctggttttacatccacggtgtcttctaccacctggccaagaggctcacggggatcacgtacccgttggcacctctgcctatcctgacccccagctgatgcccctgcttccagattcagcaacgaagcctcccccgtggtcccaccaccatgtccacctgcc

SEQ ID NO: 4965 - DNA, 263 bp, synthetic construct
  misc_feature 1..263: note = Synthetic polypeptide
  source 1..263: mol_type = other DNA
atggccgccgctacggcctccccccgcagcctccttgttctcctccaggtggtagtgctcgctctggcgcagattagaggtccaccgggagagcggggccccccgggtcccccgggaccgccgggagtgcctggatccgacggcatcgacggtgacaatgggccccctggaaaagctggccctccgggacccaagggcgagcctggcaaagctgggccagatgggccagacgggaagcccgggattgatggttactatgggaa

SEQ ID NO: 4966 - DNA, 228 bp, synthetic construct
  misc_feature 1..228: note = Synthetic polypeptide
  source 1..228: mol_type = other DNA
gtctcccttccgagggccgccgggggctgcgggcgcgcggagaggtccaccgggagagcggggccccccgggtcccccgggaccgccgggagtgcctggatccgacggcatcgacggtgacaatgggccccctggaaaagctggccctccgggacccaagggcgagcctggcaaagctgggccagatgggccagacgggaagcccgggattgatggttactatgggaa

SEQ ID NO: 4967 - DNA, 294 bp, synthetic construct
  misc_feature 1..294: note = Synthetic polypeptide
  source 1..294: mol_type = other DNA
atgtggaatctccttcacgaaaccgactcggctgtggccaccgcgcgccgcccgcgctggctgtgcgctggggcgctggtgctggcgggtggcttctttctcctcggcttcctcttcggcctccatcctcttcatcctgttcatttttcagatctcagttcaagcatctcgtcctcagtgtggtgtttcctgatccctcactctaatccaagtctttctgttttatgcacaggtggaatcttatttccgtttgcgtgcaatcatgtattttaatatgcatgtatatatgtatgt

SEQ ID NO: 4968 - DNA, 468 bp, synthetic construct
  misc_feature 1..468: note = Synthetic polypeptide
  source 1..468: mol_type = other DNA
atggtgctgtgggagtccccgcggcagtgcagcagctggacactttgcgagggcttttgctggctgctgctgctgcccgtcatgctactcatcgtagcccgcccggtgaagctcgctgctttccctacctccttaagtgactgccaaacgcccaccggctggaattgctctggttatgatgacagagaaaatgatctcttcctctgtgacaccaacacctgtaaatttgatggggaatgtttaagaattggagacactgtgacttgcgtctgtcagttcaagtgcaacaatgactatgtgcctgtgtgtggctccaatggggagagctaccagaatgagtgttacctgcgacaggctgcatgcaaacagcagagtgagatacttgtggtgtcagaaggatcatgtgccacagatgcaggatcaggatctggagatggagtaaaatgtgagctgcaagagatcagggac

SEQ ID NO: 4969 - DNA, 1757 bp, synthetic construct
  misc_feature 1..1757: note = Synthetic polypeptide
  source 1..1757: mol_type = other DNA
atgtcagctcagtgctgtgcgggccagctggcctgctgctgtgggtctgcaggctgctctctctgctgtgattgctgccccaggattcggcagtccctcagcacccgcttcatgtacgccctctacttcattctggtcgtcgtcctctgctgcatcatgatgtcaacaaccgtggctcacaagatgaaagagcacattcctttttttgaagatatgtgtaaaggcattaaagctggtgacacctgtgagaagctggtgggatattctgccgtgtatagagtctgttttggaatggcttgtttcttctttatcttctgtctactgaccttgaaaatcaacaacagcaaaagttgtagagctcatattcacaatggcttttggttctttaaacttctgctgttgggggccatgtgctcaggagctttcttcattccagatcaggacacctttctgaacgcctggcgctatgtgggagccgtcggaggcttcctcttcattggcatccagctcctcctgctcgtggagtttgcacataagtggaacaagaactggacagcaggcacagccagtaacaagctgtggtacgcctccctggccctggtgacgctcatcatgtattccattgccactggaggcttggttttgatggcagtgttttatacacagaaagacagctgcatggaaaacaaaattctgctgggagtaaatggaggcctgtgcctgcttatatcattggtagccatctcaccctgggtccaaaatcgacagccacactcggggctcttacaatcaggggtcataagctgctatgtcacctacctcaccttctcagctctgtccagcaaacctgcagaagtagttctagatgaacatgggaaaaatgttacaatctgtgtgcctgactttggtcaagacctgtacagagatgaaaacttggtgactatactggggaccagcctcttaatcggatgtatcttgtattcatgtttgacatcaacaacaagatcgagttctgacgctctgcaggggcgatacgcagctcctgaattggagatagctcgctgttgtttttgcttcagtcctggtggagaggacactgaagagcagcagccggggaaggagggaccacgggtcatttatgacgagaagaaaggcaccgtctacatctactcctacttccacttcgtgttcttcctagcttccctgtatgtgatgatgaccgtcaccaactggttcaactgagaaacctgaacggactccatttggctccttcatttgcaagacatcaagggctccttacccacccccttcctcaaggaattaacttgtgcaagctgactcccagcacatcaaagaatgcaattaactgataacatgctgtggcaagctatgtccgcagttcccaggaatttgtccagttgatattaccctaagcccctgtgtttttgtctggttgatagcacccaaagcccagcgtctatcaccttgtgatggatttaaagcccctgcacctggaactgtttgctttcctgtaaccatttgtctttttaacttcttttgcctgttttacttctgtaagactgctacagctaggctccccctcccctctctaaaccaaagtataaaacaaaatctagccccttcttcagggccgagagaattttgagcactagccgtctctcggtcgctggctaataaaggactcctcaattcgtctcagagtgtggcgtttctgtataactcgctcggttacaaca

SEQ ID NO: 4970 - DNA, 1751 bp, synthetic construct
  misc_feature 1..1751: note = Synthetic polypeptide
  source 1..1751: mol_type = other DNA
atgtcagctcagtgctgtgcgggccagctggcctgctgctgtgggtctgcaggctgctctctctgctgtgattgctgccccaggattcggcagtccctcagcacccgcttcatgtacgccctctacttcattctggtcgtcgtcctctgctgcatcatgatgtcaacaaccgtggctcacaagatgaaagagcacattcctttttttgaagatatgtgtaaaggcattaaagctggtgacacctgtgagaagctggtgggatattctgccgtgtatagagtctgttttggaatggcttgtttcttctttatcttctgtctactgaccttgaaaatcaacaacagcaaaagttgtagagctcatattcacaatggcttttggttctttaaacttctgctgttgggggccatgtgctcaggagctttcttcattccagatcaggacacctttctgaacgcctggcgctatgtgggagccgtcggaggcttcctcttcattggcatccagctcctcctgctcgtggagtttgcacataagtggaacaagaactggacagcaggcacagccagtaacaagctgtggtacgcctccctggccctggtgacgctcatcatgtattccattgccactggaggcttggttttgatggcagtgttttatacacagaaagacagctgcatggaaaacaaaattctgctgggagtaaatggaggcctgtgcctgcttatatcattggtagccatctcaccctgggtccaaaatcgacagccacactcggggctcttacaatcaggggtcataagctgctatgtcacctacctcaccttctcagctctgtccagcaaacctgcagaagtagatgaacatgggaaaaatgttacaatctgtgtgcctgactttggtcaagacctgtacagagatgaaaacttggtgactatactggggaccagcctcttaatcggatgtatcttgtattcatgtttgacatcaacaacaagatcgagttctgacgctctgcaggggcgatacgcagctcctgaattggagatagctcgctgttgtttttgcttcagtcctggtggagaggacactgaagagcagcagccggggaaggagggaccacgggtcatttatgacgagaagaaaggcaccgtctacatctactcctacttccacttcgtgttcttcctagcttccctgtatgtgatgatgaccgtcaccaactggttcaactgagaaacctgaacggactccatttggctccttcatttgcaagacatcaagggctccttacccacccccttcctcaaggaattaacttgtgcaagctgactcccagcacatcaaagaatgcaattaactgataacatgctgtggcaagctatgtccgcagttcccaggaatttgtccagttgatattaccctaagcccctgtgtttttgtctggttgatagcacccaaagcccagcgtctatcaccttgtgatggatttaaagcccctgcacctggaactgtttgctttcctgtaaccatttgtctttttaacttcttttgcctgttttacttctgtaagactgctacagctaggctccccctcccctctctaaaccaaagtataaaacaaaatctagccccttcttcagggccgagagaattttgagcactagccgtctctcggtcgctggctaataaaggactcctcaattcgtctcagagtgtggcgtttctgtataactcgctcggttacaaca

SEQ ID NO: 4971 - DNA, 559 bp, synthetic construct; identical to SEQ ID NO: 1701
  misc_feature 1..559: note = Synthetic polypeptide
  source 1..559: mol_type = other DNA

SEQ ID NO: 4972 - DNA, 1168 bp, synthetic construct; identical to SEQ ID NO: 1703
  misc_feature 1..1168: note = Synthetic polypeptide
  source 1..1168: mol_type = other DNA

SEQ ID NO: 4973 - DNA, 640 bp, synthetic construct; identical to SEQ ID NO: 1700
  misc_feature 1..640: note = Synthetic polypeptide
  source 1..640: mol_type = other DNA

SEQ ID NO: 4974 - DNA, 1598 bp, synthetic construct; identical to SEQ ID NO: 1699
  misc_feature 1..1598: note = Synthetic polypeptide
  source 1..1598: mol_type = other DNA

SEQ ID NO: 4975 - DNA, 3992 bp, synthetic construct; identical to SEQ ID NO: 120
  misc_feature 1..3992: note = Synthetic polypeptide
  source 1..3992: mol_type = other DNA

SEQ ID NO: 4976 - DNA, 3845 bp, synthetic construct; identical to SEQ ID NO: 121
  misc_feature 1..3845: note = Synthetic polypeptide
  source 1..3845: mol_type = other DNA

SEQ ID NO: 4977 - DNA, 412 bp, synthetic construct; identical to SEQ ID NO: 1704
  misc_feature 1..412: note = Synthetic polypeptide
  source 1..412: mol_type = other DNA

SEQ ID NO: 4978 - DNA, 4024 bp, synthetic construct; identical to SEQ ID NO: 1712
  misc_feature 1..4024: note = Synthetic polypeptide
  source 1..4024: mol_type = other DNA

SEQ ID NO: 4979 - DNA, 4060 bp, synthetic construct; identical to SEQ ID NO: 1713
  misc_feature 1..4060: note = Synthetic polypeptide
  source 1..4060: mol_type = other DNA

SEQ ID NO: 4980 - DNA, 1737 bp, synthetic construct
  misc_feature 1..1737: note = Synthetic polypeptide
  source 1..1737: mol_type = other DNA
atgaacctagagcggctgcggaagcgcgtccggcagtacctcgaccagcaacagtatcaaagtgctctattttgggcagataaagtagcttcactctctcgtgaagaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattgcacctaactggaaatgactcaaacgtccaccagtaggagagaggagaaataaattgtggtatgttcatacaatagaatactatattatttgaaagactactgaatcatttagaaacatgcatcagtttcacaga

SEQ ID NO: 4981 - DNA, 1302 bp, synthetic construct
  misc_feature 1..1302: note = Synthetic polypeptide
  source 1..1302: mol_type = other DNA
atggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaaggatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattgcacctaactggaaatgactcaaacgtccaccagtaggagagaggagaaataaattgtggtatgttcatacaatagaatactatattatttgaaagactactgaatcatttagaaacatgcatcagtttcacaga

SEQ ID NO: 4982 - DNA, 1455 bp, synthetic construct
  misc_feature 1..1455: note = Synthetic polypeptide
  source 1..1455: mol_type = other DNA
atggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattgcacctaactggaaatgactcaaacgtccaccagtaggagagaggagaaataaattgtggtatgttcatacaatagaatactatattatttgaaagactactgaatcatttagaaacatgcatcagtttcacaga

SEQ ID NO: 4983 - DNA, 1734 bp, synthetic construct
  misc_feature 1..1734: note = Synthetic polypeptide
  source 1..1734: mol_type = other DNA
atgaacctagagcggctgcggaagcgcgtccggcagtacctcgaccagcaacagtatcaaagtgctctattttgggcagataaagtagcttcactctctcgtgaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattgcacctaactggaaatgactcaaacgtccaccagtaggagagaggagaaataaattgtggtatgttcatacaatagaatactatattatttgaaagactactgaatcatttagaaacatgcatcagtttcacaga

SEQ ID NO: 4984 - DNA, 225 bp, synthetic construct; identical to SEQ ID NO: 1702
  misc_feature 1..225: note = Synthetic polypeptide
  source 1..225: mol_type = other DNA

SEQ ID NO: 4985 - DNA, 1273 bp, synthetic construct; identical to SEQ ID NO: 1927
  misc_feature 1..1273: note = Synthetic polypeptide
  source 1..1273: mol_type = other DNA

SEQ ID NO: 4986 - DNA, 1516 bp, synthetic construct; identical to SEQ ID NO: 1928
  misc_feature 1..1516: note = Synthetic polypeptide
  source 1..1516: mol_type = other DNA

SEQ ID NO: 4987 - DNA, 1393 bp, synthetic construct; identical to SEQ ID NO: 1929
  misc_feature 1..1393: note = Synthetic polypeptide
  source 1..1393: mol_type = other DNA

SEQ ID NO: 4988 - DNA, 500 bp, synthetic construct; identical to SEQ ID NO: 204
  misc_feature 1..500: note = Synthetic polypeptide
  source 1..500: mol_type = other DNA

SEQ ID NO: 4989 - DNA, 656 bp, synthetic construct; identical to SEQ ID NO: 205
  misc_feature 1..656: note = Synthetic polypeptide
  source 1..656: mol_type = other DNA

SEQ ID NO: 4990 - DNA, 524 bp, synthetic construct; identical to SEQ ID NO: 207
  misc_feature 1..524: note = Synthetic polypeptide
  source 1..524: mol_type = other DNA

SEQ ID NO: 4991 - DNA, 442 bp, synthetic construct; identical to SEQ ID NO: 1723
  misc_feature 1..442: note = Synthetic polypeptide
  source 1..442: mol_type = other DNA

SEQ ID NO: 4992 - DNA, 966 bp, synthetic construct
  misc_feature 1..966: note = Synthetic polypeptide
  source 1..966: mol_type = other DNA
atggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatgcagagacaaaaagccccaaggaaaccaggaggctgggaagacagtccaatccagcaagacagaactctgaccgtcactgcctcactccagtgccaggcgcaaagaagtcagcaggtccgtcccaccccatctgcaaagtggtgcggactgggggtggcccaggacctccaccctgggctagcagtaatgaggagctagtccccctccccaccaggtggatgtcagaggctaagcaggggacctagacctccccgactcagtggctaaggggatgcacctgtttctctgcttgcatggtgaggcctgctaaacaagataaataaagtccatagtctcgtcaggtagtgcctcaaatgtccgggatctaatcgacactgattaccaggaaaatctcaactttcagagatttcaaatgagaaaaaacattcagcagaagacaccaaggctgagattgtacaaatgttggaattatgtgacaagagttttaaacagccctcttgattcagcaagcaatttagaacatgcttgaaacaaatgaaaacatttaaagtctcaacaaggaaataggcgatataaagaagaaccaaatggaaattttagaa

SEQ ID NO: 4993 - DNA, 960 bp, synthetic construct
  misc_feature 1..960: note = Synthetic polypeptide
  source 1..960: mol_type = other DNA
atgcgtctgacagatgttgttcaacagcttgtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatgcagagacaaaaagccccaaggaaaccaggaggctgggaagacagtccaatccagcaagacagaactctgaccgtcactgcctcactccagtgccaggcgcaaagaagtcagcaggtccgtcccaccccatctgcaaagtggtgcggactgggggtggcccaggacctccaccctgggctagcagtaatgaggagctagtccccctccccaccaggtggatgtcagaggctaagcaggggacctagacctccccgactcagtggctaaggggatgcacctgtttctctgcttgcatggtgaggcctgctaaacaagataaataaagtccatagtctcgtcaggtagtgcctcaaatgtccgggatctaatcgacactgattaccaggaaaatctcaactttcagagatttcaaatgagaaaaaacattcagcagaagacaccaaggctgagattgtacaaatgttggaattatgtgacaagagttttaaacagccctcttgattcagcaagcaatttagaacatgcttgaaacaaatgaaaacatttaaagtctcaacaaggaaataggcgatataaagaagaaccaaatggaaattttagaa

SEQ ID NO: 4994 - DNA, 1128 bp, synthetic construct
  misc_feature 1..1128: note = Synthetic polypeptide
  source 1..1128: mol_type = other DNA
atggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatatcctttgtcgttcatggcagctgtcccgcatagaacacatgcagtggattacttgggacttgagacccggaaacactgggccagttgctcatttctgcagttagaaaggaatgacagtgttttggaacagaagctcgtttcagctctttcacttggtacatcattcttgcgagcattccaggcccacaaagaagaaaactgggctctgcctgtcatgtatgcagtagcgcttgaccttcgagtgtttgccaataatgcagagacaaaaagccccaaggaaaccaggaggctgggaagacagtccaatccagcaagacagaactctgaccgtcactgcctcactccagtgccaggcgcaaagaagtcagcaggtccgtcccaccccatctgcaaagtggtgcggactgggggtggcccaggacctccaccctgggctagcagtaatgaggagctagtccccctccccaccaggtggatgtcagaggctaagcaggggacctagacctccccgactcagtggctaaggggatgcacctgtttctctgcttgcatggtgaggcctgctaaacaagataaataaagtccatagtctcgtcaggtagtgcctcaaatgtccgggatctaatcgacactgattaccaggaaaatctcaactttcagagatttcaaatgagaaaaaacattcagcagaagacaccaaggctgagattgtacaaatgttggaattatgtgacaagagttttaaacagccctcttgattcagcaagcaatttagaacatgcttgaaacaaatgaaaacatttaaagtctcaacaaggaaataggcgatataaagaagaaccaaatggaaattttagaa

SEQ ID NO: 4995 - DNA, 1721 bp, synthetic construct; identical to SEQ ID NO: 1726
  misc_feature 1..1721: note = Synthetic polypeptide
  source 1..1721: mol_type = other DNA

SEQ ID NO: 4996 - DNA, 312 bp, synthetic construct; identical to SEQ ID NO: 1728
  misc_feature 1..312: note = Synthetic polypeptide
  source 1..312: mol_type = other DNA

SEQ ID NO: 4997 - DNA, 725 bp, synthetic construct; identical to SEQ ID NO: 1705
  misc_feature 1..725: note = Synthetic polypeptide
  source 1..725: mol_type = other DNA

SEQ ID NO: 4998 - DNA, 815 bp, synthetic construct; identical to SEQ ID NO: 1706
  misc_feature 1..815: note = Synthetic polypeptide
  source 1..815: mol_type = other DNA

SEQ ID NO: 4999 - DNA, 2466 bp, synthetic construct; identical to SEQ ID NO: 1682
  misc_feature 1..2466: note = Synthetic polypeptide
  source 1..2466: mol_type = other DNA

SEQ ID NO: 5000 - DNA, 1806 bp, synthetic construct; identical to SEQ ID NO: 1683
  misc_feature 1..1806: note = Synthetic polypeptide
  source 1..1806: mol_type = other DNA

SEQ ID NO: 5001 - DNA, 2412 bp, synthetic construct; identical to SEQ ID NO: 1684
  misc_feature 1..2412: note = Synthetic polypeptide
  source 1..2412: mol_type = other DNA

SEQ ID NO: 5002 - DNA, 2211 bp, synthetic construct; identical to SEQ ID NO: 1685
  misc_feature 1..2211: note = Synthetic polypeptide
  source 1..2211: mol_type = other DNA

SEQ ID NO: 5003 - DNA, 364 bp, synthetic construct; identical to SEQ ID NO: 1686
  misc_feature 1..364: note = Synthetic polypeptide
  source 1..364: mol_type = other DNA

SEQ ID NO: 5004 - DNA, 520 bp, synthetic construct; identical to SEQ ID NO: 1727
  misc_feature 1..520: note = Synthetic polypeptide
  source 1..520: mol_type = other DNA

SEQ ID NO: 5005 - DNA, 1558 bp, synthetic construct
  misc_feature 1..1558: note = Synthetic polypeptide
  source 1..1558: mol_type = other DNA
atggccaccaaggagaagctgcagtgtctgaaagatttccacaaggacatcctgaagccctcaccagggaagagcccaggcacgcggcctgaggacgaggctgagggaaaacctccgcagagggagaagtggtctagcaagatcgactttgtgctctctgtggctggcggcttcgtgggcttgggcaacgtctggcgcttcccgtacctctgctacaagaatggtggaggtgcgtttctcataccgtattttattttcctgtttgggagcggcctgcctgtgtttttcttggagatcatcataggccagtacacctctgaagggggcatcacctgctgggaaaagatctgccccttgttctctggtatcggctatgcctccgttgtaattgtgtccctcctgaatgtctactacatcgtcatcctggcctgggccacatactacctgttccagtccttccagaaggagctgccctgggcacactgcaaccacagctggaacacacctcactgcatggaggacaccatgcgcaagaacaagagtgtctggatcaccatcagctccaccaacttcacctcccctgtcatcgagttctgggagcgcaacgtgctgagcttgtcccctggaatcgaccacccaggctctctgaaatgggacctcgctctctgccttcttttagtctggctagtgtgtttcttctgcatctggaagggcgtcaggtccactgggaaggtcgtctacttcacagccacttttccattcgccatgctcctggtgctgctggtccgagggctgacgctgccgggcgcgggcgcaggcatcaagttctatctgtatcctgacatcacccgccttgaggacccacaggtgtggattgacgctgggactcagatattcttctcttatgccatctgcctgggggctatgacctcgctggggagctacaacaagtacaagtataactcgtacagggactgtatgctgctgggatgcctgaacagtggtaccagttttgtgtctggcttcgcaattttttccatcctgggcttcatggcacaagagcaaggggtggacattgctgatgtggctgagtcaggtcctggcctggccttcattgcctacccaaaagctgtgacaatgatgccgctgcccacattttggtccattcttttttttattatgcttctcttgcttggactggatagccagtttgttgaagttgaaggacagatcacatccttggttgatctttacccatccttcctaaggaagggttatcgtcgggaaatcttcatcgccttcgtgtgtagcatcagctacctgctggggctgacgatggtgacggagggtggcatgtatgtgtttcagctctttgactactatgcagctagcggtgtatgccttttgtgggttgcattctttgaatgttttgttattgcctggatatatggaggtgataacctttatgatggtattgaggacatgattggctatcggcccgggccctggatgaagtacagctgggctgtgatcactccagttctctgtgttgagactg

SEQ ID NO: 5006 - DNA, 1221 bp, synthetic construct; identical to SEQ ID NO: 122
  misc_feature 1..1221: note = Synthetic polypeptide
  source 1..1221: mol_type = other DNA

SEQ ID NO: 5007 - DNA, 1081 bp, synthetic construct; identical to SEQ ID NO: 986
  misc_feature 1..1081: note = Synthetic polypeptide
  source 1..1081: mol_type = other DNA

SEQ ID NO: 5008 - DNA, 1054 bp, synthetic construct; identical to SEQ ID NO: 987
  misc_feature 1..1054: note = Synthetic polypeptide
  source 1..1054: mol_type = other DNA

SEQ ID NO: 5009 - DNA, 1146 bp, synthetic construct; identical to SEQ ID NO: 988
  misc_feature 1..1146: note = Synthetic polypeptide
  source 1..1146: mol_type = other DNA

SEQ ID NO: 5010 - DNA, 646 bp, synthetic construct
  misc_feature 1..646: note = Synthetic polypeptide
  source 1..646: mol_type = other DNA
atgacggccggcggccaggccgaggccgagggcgctggcggggagcccggcgcggcgcggctgccctcgcgggtggcccggctgctgtcggcgctcttctacgggacctgctccttcctcatcgtgcttgtcaacaaggcgctgctgaccacctacggtttcccgtcaccaattttccttggaattggacagatggcagccaccataatgatactatatgtgtccaagctaaacaaaatcattcacttccctgattttgataagaaaattcctgtaaagctgtttcctctgcctctcctctacgttggaaaccacataagtggattatcaagcacaagtaaattaagcccagtgcggtggctcacgcctataatcccagcactttgggaggctgaggcaggtggatcgcctgagatcaggagttcgagaccagcctggccaacatggcaaaacttcatttctactaaaaatacaaaaattagctgggcgtggtagtgtaatcccagctacccgagaggctgaggcaggagaatcgcttgaacccgggaggtggggattgcagtgagctgagatcgcgccactgcactccagcctgggtgacagagtgagactctatctctaaataaataaataaataaataaataa

SEQ ID NO: 5011 - DNA, 117 bp, synthetic construct; identical to SEQ ID NO: 928
  misc_feature 1..117: note = Synthetic polypeptide
  source 1..117: mol_type = other DNA

SEQ ID NO: 5012 - DNA, 51 bp, synthetic construct; identical to SEQ ID NO: 929
  misc_feature 1..51: note = Synthetic polypeptide
  source 1..51: mol_type = other DNA

SEQ ID NO: 5013 - DNA, 980 bp, synthetic construct; identical to SEQ ID NO: 139
  misc_feature 1..980: note = Synthetic polypeptide
  source 1..980: mol_type = other DNA

SEQ ID NO: 5014 - DNA, 1256 bp, synthetic construct; identical to SEQ ID NO: 140
  misc_feature 1..1256: note = Synthetic polypeptide
  source 1..1256: mol_type = other DNA

SEQ ID NO: 5015 - DNA, 1277 bp, synthetic construct; identical to SEQ ID NO: 142
  misc_feature 1..1277: note = Synthetic polypeptide
  source 1..1277: mol_type = other DNA

SEQ ID NO: 5016 - DNA, 609 bp, synthetic construct; identical to SEQ ID NO: 249
  misc_feature 1..609: note = Synthetic polypeptide
  source 1..609: mol_type = other DNA

SEQ ID NO: 5017 - DNA, 738 bp, synthetic construct; identical to SEQ ID NO: 250
  misc_feature 1..738: note = Synthetic polypeptide
  source 1..738: mol_type = other DNA

SEQ ID NO: 5018 - DNA, 537 bp, synthetic construct; identical to SEQ ID NO: 251
  misc_feature 1..537: note = Synthetic polypeptide
  source 1..537: mol_type = other DNA

SEQ ID NO: 5019 - DNA, 684 bp, synthetic construct; identical to SEQ ID NO: 253
  misc_feature 1..684: note = Synthetic polypeptide
  source 1..684: mol_type = other DNA

SEQ ID NO: 5020 - DNA, 285 bp, synthetic construct; identical to SEQ ID NO: 255
  misc_feature 1..285: note = Synthetic polypeptide
  source 1..285: mol_type = other DNA

SEQ ID NO: 5021 - DNA, 552 bp, synthetic construct; identical to SEQ ID NO: 254
  misc_feature 1..552: note = Synthetic polypeptide
  source 1..552: mol_type = other DNA

SEQ ID NO: 5022 - DNA, 3723 bp, synthetic construct; identical to SEQ ID NO: 1743
  misc_feature 1..3723: note = Synthetic polypeptide
  source 1..3723: mol_type = other DNA

SEQ ID NO: 5023 - DNA, 3708 bp, synthetic construct; identical to SEQ ID NO: 1744
  misc_feature 1..3708: note = Synthetic polypeptide
  source 1..3708: mol_type = other DNA

SEQ ID NO: 5024 - DNA, 3333 bp, synthetic construct; identical to SEQ ID NO: 1745
  misc_feature 1..3333: note = Synthetic polypeptide
  source 1..3333: mol_type = other DNA

SEQ ID NO: 5025 - DNA, 366 bp, synthetic construct; identical to SEQ ID NO: 1772
  misc_feature 1..366: note = Synthetic polypeptide
  source 1..366: mol_type = other DNA

SEQ ID NO: 5026 - DNA, 679 bp, synthetic construct; identical to SEQ ID NO: 1729
  misc_feature 1..679: note = Synthetic polypeptide
  source 1..679: mol_type = other DNA

SEQ ID NO: 5027 - DNA, 2501 bp, synthetic construct; identical to SEQ ID NO: 1164
  misc_feature 1..2501: note = Synthetic polypeptide
  source 1..2501: mol_type = other DNA

SEQ ID NO: 5028 - DNA, 2552 bp, synthetic construct; identical to SEQ ID NO: 1165
  misc_feature 1..2552: note = Synthetic polypeptide
  source 1..2552: mol_type = other DNA

SEQ ID NO: 5029 - DNA, 2456 bp, synthetic construct; identical to SEQ ID NO: 1166
  misc_feature 1..2456: note = Synthetic polypeptide
  source 1..2456: mol_type = other DNA

SEQ ID NO: 5030 - DNA, 588 bp, synthetic construct; identical to SEQ ID NO: 1167
  misc_feature 1..588: note = Synthetic polypeptide
  source 1..588: mol_type = other DNA

SEQ ID NO: 5031 - DNA, 1034 bp, synthetic construct; identical to SEQ ID NO: 4670
  misc_feature 1..1034: note = Synthetic polypeptide
  source 1..1034: mol_type = other DNA

SEQ ID NO: 5032 - DNA, 1586 bp, synthetic construct; identical to SEQ ID NO: 4671
  misc_feature 1..1586: note = Synthetic polypeptide
  source 1..1586: mol_type = other DNA

SEQ ID NO: 5033 - DNA, 1588 bp, synthetic construct; identical to SEQ ID NO: 4672
  misc_feature 1..1588: note = Synthetic polypeptide
  source 1..1588: mol_type = other DNA

SEQ ID NO: 5034 - DNA, 1476 bp, synthetic construct; identical to SEQ ID NO: 3948
  misc_feature 1..1476: note = Synthetic polypeptide
  source 1..1476: mol_type = other DNA

SEQ ID NO: 5035 - DNA, 4932 bp, synthetic construct; identical to SEQ ID NO: 3990
  misc_feature 1..4932: note = Synthetic polypeptide
  source 1..4932: mol_type = other DNA

SEQ ID NO: 5036 - DNA, 1825 bp, synthetic construct; identical to SEQ ID NO: 1660
  misc_feature 1..1825: note = Synthetic polypeptide
  source 1..1825: mol_type = other DNA

SEQ ID NO: 5037 - DNA, 1825 bp, synthetic construct; identical to SEQ ID NO: 1661
  misc_feature 1..1825: note = Synthetic polypeptide
  source 1..1825: mol_type = other DNA

SEQ ID NO: 5038 - DNA, 1275 bp, synthetic construct
  misc_feature 1..1275: note = Synthetic polypeptide
  source 1..1275: mol_type = other DNA
atggttcccgaggtgagggtcctctcctccttgctgggactcgcgctgctctggttccccctggactcccacgctcgagcccgcccagacatgttctgccttttccatgggaagagatactcccccggcgagagctggcacccctacttggagccacaaggcctgatgtactgcctgcgctgtacctgctcagagggcgcccatgtgagttgttaccgcctccactgtccgcctgtccactgcccccagcctgtgacggagccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacagagggccagatctactgcggcctcacaacctgccccgaaccaggctgcccagcacccctcccgctgccagactcctgctgccaggcctgcaaagatgaggcaagtgagcaatcggatgaagaggacagtgtgcagtcgctccatggggtgagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagcctgtgtgcatggcgggaagacgtactcccacggggaggtgtggcacccggccttccgtgccttcggccccttgccctgcatcctatgcacctgtgaggatggccgccaggactgccagcgtgtgacctgtcccaccgagtacccctgccgtcaccccgagaaagtggctgggaagtgctgcaagatttgcccagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaaggaggaatggacgaagaaagtggagctgttcagcctggagaagagaagactcagggggacaggactgctggcttcgtggctctgaagggctgtcccaggcagagggagcagctgtgttctgagtgaccgcaagagtcaaacaacaagcaggggctt

SEQ ID NO: 5039 - DNA, 1080 bp, synthetic construct
  misc_feature 1..1080: note = Synthetic polypeptide
  source 1..1080: mol_type = other DNA
atggttcccgaggtgagggtcctctcctccttgctgggactcgcgctgctctggttccccctggactcccacgctcgagcccgcccagacatgttctgccttttccatgggaagagatactcccccggcgagagctggcacccctacttggagccacaaggcctgatgtactgcctgcgctgtacctgctcagagggcgcccatgtgagttgttaccgcctccactgtccgcctgtccactgcccccagcctgtgacggagccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacagagggccagatctactgcggcctcacaacctgccccgaaccaggctgcccagcacccctcccgctgccagactcctgctgccaggcctgcaaagatgaggcaagtgagcaatcggatgaagaggacagtgtgcagtcgctccatggggtgagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaaggaggaatggacgaagaaagtggagctgttcagcctggagaagagaagactcagggggacaggactgctggcttcgtggctctgaagggctgtcccaggcagagggagcagctgtgttctgagtgaccgcaagagtcaaacaacaagcaggggctt

SEQ ID NO: 5040 - DNA, 1052 bp, synthetic construct; identical to SEQ ID NO: 247
  misc_feature 1..1052: note = Synthetic polypeptide
  source 1..1052: mol_type = other DNA

SEQ ID NO: 5041 - DNA, 327 bp, synthetic construct; identical to SEQ ID NO: 246
  misc_feature 1..327: note = Synthetic polypeptide
  source 1..327: mol_type = other DNA

SEQ ID NO: 5042 - DNA, 1189 bp, synthetic construct
  misc_feature 1..1189: note = Synthetic polypeptide
  source 1..1189: mol_type = other DNA
atgggctggaggccccggagagctcgggggaccccgttgctgctgctgctactactgctgctgctctggccagtgccaggcgccggggtgcttcaaggacatatccctgggcagccagtcaccccgcactgggtcctggatggacaaccctggcgcaccgtcagcctggaggagccggtctcgaagccagacatggggctggtggccctggaggctgaaggccaggagctcctgcttgagctggagaagaaccacaggctgctggccccaggatacatagaaacccactacggcccagatgggcagccagtggtgctggcccccaaccacacggatcattgccactaccaagggcgagtaaggggcttccccgactcctgggtagtcctctgcacctgctctgggatgagtggcctgatcaccctcagcaggaatgccagctattatctgcgtccctggccaccccggggctccaaggacttctcaacccacgagatctttcggatggagcagctgctcacctggaaaggaacctgtggccacagggatcctgggaacaaagcgggcatgaccagccttcctggtggtccccagagcaggggcaggcgagaagcgcgcaggacccggaagtacctggaactgtacattgtggcagaccacaccctgttcttgactcggcaccgaaacttgaaccacaccaaacagcgtctcctggaagtcgccaactacgtggaccagcttctcaggactctggacattcaggtggcgctgaccggcctggaggtgtggaccgagcgggaccgcagccgcgtcacgcaggacgccaacgccacgctctgggccttcctgcagtggcgccgggggctgtgggcgcagcggccccacgactccgcgcagctgctcacgggccgcgccttccagggcgccacagtgggcctggcgcccgtcgagggcatgtgccgcgccgagagctcgggaggcgtgagcacggaccactcggagctccccatcggcgccgcagccaccatggcccatgagatcggccacagcctcggcctcagccacgaccccgacggctgctgcgtggaggctgcggccgagtccggaggctgcgtcatggctgcggccaccggggtggtttatgaggcttaaagggaagaagctcaggcaaagtggattctcaacggta

SEQ ID NO: 5043 - DNA, 2239 bp, synthetic construct
  misc_feature 1..2239: note = Synthetic polypeptide
  source 1..2239: mol_type = other DNA
atggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgcaaggcccatcttttgcctacggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagagggcatggtagcacatacctgtggtcccaaatacttgggaggctgatttgggaggatcacttgagcccaggagtttgaggctgcagtgagccatgatcgcaccactggactccagcctggctgacagaatgggaccctatctcaaaaaataaaaaggacaaa

SEQ ID NO: 5044 - DNA, 2218 bp, synthetic construct
  misc_feature 1..2218: note = Synthetic polypeptide
  source 1..2218: mol_type = other DNA
atggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagagggcatggtagcacatacctgtggtcccaaatacttgggaggctgatttgggaggatcacttgagcccaggagtttgaggctgcagtgagccatgatcgcaccactggactccagcctggctgacagaatgggaccctatctcaaaaaataaaaaggacaaa

SEQ ID NO: 5045 - DNA, 367 bp, synthetic construct
  misc_feature 1..367: note = Synthetic polypeptide
  source 1..367: mol_type = other DNA
atggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggccacctgcgccccaccctcagcacctgtttttgcctgtgtgacctcagacaagtgactgcacctctctgagcctcagtttcctcctcagtaaaatgtggattgta

SEQ ID NO: 5046 - DNA, 767 bp, synthetic construct; identical to SEQ ID NO: 937
  misc_feature 1..767: note = Synthetic polypeptide
  source 1..767: mol_type = other DNA

SEQ ID NO: 5047 - DNA, 677 bp, synthetic construct; identical to SEQ ID NO: 938
  misc_feature 1..677: note = Synthetic polypeptide
  source 1..677: mol_type = other DNA

SEQ ID NO: 5048 - DNA, 3661 bp, synthetic construct
  misc_feature 1..3661: note = Synthetic polypeptide
  source 1..3661: mol_type = other DNA
atgaagattttccagcgcaagatgcggtactggttgcttccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagcaattattcaaggccttatgccagaccagaattacacagttcaaattattgcatacaataaagataaagaaagcaagccagctcaaggccaattcagaattaaagatttagaaaaaagaaaggatccaaagcccagagtcaaagttgtggacagaggaaatgggagtagaccatcttcaccagaagaagtgaaatttgtctgtcaaactccagcaattgctgacattgtaatcctggtcgatggttcatggagtattggaagattcaacttcagactggttcggcatttcttggaaaacctggttacagcattcgatgtgggctcagagaagacacgaattggtcttgcacagtatagtggtgaccccagaatagaatggcacttgaatgcatttagcacaaaagatgaagtgattgaagctgtccgaaacctcccatataaaggaggaaatacactaacaggtcttgctttgaactacatttttgaaaatagcttcaaaccagaagcaggatcaaggactggagtatccaaaattggcattttaatcacagatggaaaatcccaagatgacattattccaccatctagaaatcttcgtgagtctggtgtagaactgtttgccataggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacattggctttaagtccaccaagaaacctgagaatctccaatgttggctctaacagtgctcgattaacctgggacccaacttcaagacagatcaatggttatcgaattgtatataacaatgcagatgggactgaaatcaatgaggttgaagtcgatcctattactaccttccctctgaagggcttgacacctctcacagagtatactattgctattttctccatctatgatgaaggacagtcagagcctctgactggagtttttaccaccgaggaagttccagcccagcaatacttagaaattgatgaggtgacgacagacagttttagggtgacctggcatcccctctcagctgatgaagggctacacaaattgatgtggattccagtctatggggggaagactgaggaggttgtcctgaaagaagagcaggactcacatgttattgaaggcctggagcccggtacggagtatgaagtttcactattggccgtacttgatgatggaagcgagagtgaggtggtgactgctgtcgggaccacacttgacagtttttggacagaaccagctacaaccatagtgcctaccacatctgtgacttcagttttccagacgggaatcagaaacctagttgtaggtgatgaaactacttctagcctgcgggtaaaatgggacatttctgacagcgatgtgcagcagtttagggtgacctacatgacagctcaaggggaccctgaggaagaagtcataggaacggttatggtgcctggaagccagaacaacctccttctgaagcctctgcttcctgatactgaatacaaagtcacagtgactcccatctacacggatggcgaaggcgtcagcgtctccgctcctggaaaaaccttaccatcctcggggccccagaacttgcgggtgtccgaggaatggtataaccggttgcgcattacgtgggaccccccatcttccccggtgaaaggctatagaattgtctacaaacctgtcagtgttcctggtccaacactggaaacgtttgtgggagctgacattaacaccatccttatcacaaacctcctcagcggaatggactacaatgtgaagatatttgcctcccaggcctcaggcttcagcgacgccctgacaggcatggtgaaaacattgttcttgggtgttaccaatctccaagccaaacatgttgaaatgaccagcttgtgtgcccactggcaggtacatcgccatgccacagcctatagggttgttatagaatccctccaggataggcaaaagcaagaatccactgtgggtggagggacaaccaggcattgcttctatggacttcagcctgattctgaatataaaatcagtgtttatacaaagctccaggagattgaaggacctagtgtgagcataatggaaaaaacacaatcacttcctacacgaccaccaacttttcctccaaccattccaccagcaaaagaagtatgtaaggcggccaaggctgacctggtatttatggtggatggatcctggagcattggagatgaaaatttcaataagatcatcagctttctatacagcactgttggagccctgaacaagattggcacagatggaacccaacactattcacagtaacaaacatggaatgcccatcaatggtggactgcgtaaagaaaatgtggtgaacatacagcaagaaatactacgcagccataaaaaagaacaaaatcatgttctttgcagcaacacgggtgcctctggaagccattatcttgtgcaaattaacacagaaacatgaaaccaaatactgcatgctctcacttagaagtgggagctaaacatcgagtacacacggacgtaaagacgggaacaatagacactaggggctactagtagggggagaatagaaggaggctgaaggttgaaaaactgcctattgggaactatgctcactacctgggggacagaatcatttgtacaccacctctcagtgacatgccgtttacccatgtaacaaacctacacaatgtaccctctgaatctaaaataaaatttttaaaaaagaaaa

SEQ ID NO: 5049 - DNA, 3376 bp, synthetic construct
  misc_feature 1..3376: note = Synthetic polypeptide
  source 1..3376: mol_type = other DNA
atgaagattttccagcgcaagatgcggtactggttgcttccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagcaattattcaaggccttatgccagaccagaattacacagttcaaattattgcatacaataaagataaagaaagcaagccagctcaaggccaattcagaattaaagatttagaaaaaagaaaggatccaaagcccagagtcaaagttgtggacagaggaaatgggagtagaccatcttcaccagaagaagtgaaatttgtctgtcaaactccagcaattgctgacattgtaatcctggtcgatggttcatggagtattggaagattcaacttcagactggttcggcatttcttggaaaacctggttacagcattcgatgtgggctcagagaagacacgaattggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacattggctttaagtccaccaagaaacctgagaatctccaatgttggctctaacagtgctcgattaacctgggacccaacttcaagacagatcaatggttatcgaattgtatataacaatgcagatgggactgaaatcaatgaggttgaagtcgatcctattactaccttccctctgaagggcttgacacctctcacagagtatactattgctattttctccatctatgatgaaggacagtcagagcctctgactggagtttttaccaccgaggaagttccagcccagcaatacttagaaattgatgaggtgacgacagacagttttagggtgacctggcatcccctctcagctgatgaagggctacacaaattgatgtggattccagtctatggggggaagactgaggaggttgtcctgaaagaagagcaggactcacatgttattgaaggcctggagcccggtacggagtatgaagtttcactattggccgtacttgatgatggaagcgagagtgaggtggtgactgctgtcgggaccacacttgacagtttttggacagaaccagctacaaccatagtgcctaccacatctgtgacttcagttttccagacgggaatcagaaacctagttgtaggtgatgaaactacttctagcctgcgggtaaaatgggacatttctgacagcgatgtgcagcagtttagggtgacctacatgacagctcaaggggaccctgaggaagaagtcataggaacggttatggtgcctggaagccagaacaacctccttctgaagcctctgcttcctgatactgaatacaaagtcacagtgactcccatctacacggatggcgaaggcgtcagcgtctccgctcctggaaaaaccttaccatcctcggggccccagaacttgcgggtgtccgaggaatggtataaccggttgcgcattacgtgggaccccccatcttccccggtgaaaggctatagaattgtctacaaacctgtcagtgttcctggtccaacactggaaacgtttgtgggagctgacattaacaccatccttatcacaaacctcctcagcggaatggactacaatgtgaagatatttgcctcccaggcctcaggcttcagcgacgccctgacaggcatggtgaaaacattgttcttgggtgttaccaatctccaagccaaacatgttgaaatgaccagcttgtgtgcccactggcaggtacatcgccatgccacagcctatagggttgttatagaatccctccaggataggcaaaagcaagaatccactgtgggtggagggacaaccaggcattgcttctatggacttcagcctgattctgaatataaaatcagtgtttatacaaagctccaggagattgaaggacctagtgtgagcataatggaaaaaacacaatcacttcctacacgaccaccaacttttcctccaaccattccaccagcaaaagaagtatgtaaggcggccaaggctgacctggtatttatggtggatggatcctggagcattggagatgaaaatttcaataagatcatcagctttctatacagcactgttggagccctgaacaagattggcacagatggaacccaacactattcacagtaacaaacatggaatgcccatcaatggtggactgcgtaaagaaaatgtggtgaacatacagcaagaaatactacgcagccataaaaaagaacaaaatcatgttctttgcagcaacacgggtgcctctggaagccattatcttgtgcaaattaacacagaaacatgaaaccaaatactgcatgctctcacttagaagtgggagctaaacatcgagtacacacggacgtaaagacgggaacaatagacactaggggctactagtagggggagaatagaaggaggctgaaggttgaaaaactgcctattgggaactatgctcactacctgggggacagaatcatttgtacaccacctctcagtgacatgccgtttacccatgtaacaaacctacacaatgtaccctctgaatctaaaataaaatttttaaaaaagaaaa

SEQ ID NO: 5050 - DNA, 377 bp, synthetic construct; identical to SEQ ID NO: 2235
  misc_feature 1..377: note = Synthetic polypeptide
  source 1..377: mol_type = other DNA

SEQ ID NO: 5051 - DNA, 347 bp, synthetic construct; identical to SEQ ID NO: 2236
  misc_feature 1..347: note = Synthetic polypeptide
  source 1..347: mol_type = other DNA

SEQ ID NO: 5052 - DNA, 154 bp, synthetic construct; identical to SEQ ID NO: 2227
  misc_feature 1..154: note = Synthetic polypeptide
  source 1..154: mol_type = other DNA

SEQ ID NO: 5053 - DNA, 2466 bp, synthetic construct; identical to SEQ ID NO: 1682
  misc_feature 1..2466: note = Synthetic polypeptide
  source 1..2466: mol_type = other DNA

SEQ ID NO: 5054 - DNA, 1806 bp, synthetic construct; identical to SEQ ID NO: 1683
  misc_feature 1..1806: note = Synthetic polypeptide
  source 1..1806: mol_type = other DNA

SEQ ID NO: 5055 - DNA, 2412 bp, synthetic construct; identical to SEQ ID NO: 1684
  misc_feature 1..2412: note = Synthetic polypeptide
  source 1..2412: mol_type = other DNA

SEQ ID NO: 5056 - DNA, 2211 bp, synthetic construct; identical to SEQ ID NO: 1685
  misc_feature 1..2211: note = Synthetic polypeptide
  source 1..2211: mol_type = other DNA

SEQ ID NO: 5057 - DNA, 364 bp, synthetic construct; identical to SEQ ID NO: 1686
  misc_feature 1..364: note = Synthetic polypeptide
  source 1..364: mol_type = other DNA

SEQ ID NO: 5058 - DNA, 1398 bp, synthetic construct; identical to SEQ ID NO: 948
  misc_feature 1..1398: note = Synthetic polypeptide
  source 1..1398: mol_type = other DNA

SEQ ID NO: 5059 - DNA, 1302 bp, synthetic construct; identical to SEQ ID NO: 949
  misc_feature 1..1302: note = Synthetic polypeptide
  source 1..1302: mol_type = other DNA

SEQ ID NO: 5060 - DNA, 117 bp, synthetic construct; identical to SEQ ID NO: 928
  misc_feature 1..117: note = Synthetic polypeptide
  source 1..117: mol_type = other DNA

SEQ ID NO: 5061 - DNA, 51 bp, synthetic construct; identical to SEQ ID NO: 929
  misc_feature 1..51: note = Synthetic polypeptide
  source 1..51: mol_type = other DNA

SEQ ID NO: 5062 - DNA, 2409 bp, synthetic construct; identical to SEQ ID NO: 1481
  misc_feature 1..2409: note = Synthetic polypeptide
  source 1..2409: mol_type = other DNA

SEQ ID NO: 5063 - DNA, 316 bp, synthetic construct; identical to SEQ ID NO: 1815
  misc_feature 1..316: note = Synthetic polypeptide
  source 1..316: mol_type = other DNA

SEQ ID NO: 5064 - DNA, 1330 bp, synthetic construct
  misc_feature 1..1330: note = Synthetic polypeptide
  source 1..1330: mol_type = other DNA
atggttcccgaggtgagggtcctctcctccttgctgggactcgcgctgctctggttccccctggactcccacgctcgagcccgcccagacatgttctgccttttccatgggaagagatactcccccggcgagagctggcacccctacttggagccacaaggcctgatgtactgcctgcgctgtacctgctcagagggcgcccatgtgagttgttaccgcctccactgtccgcctgtccactgcccccagcctgtgacggagccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacagagggccagatctactgcggcctcacaacctgccccgaaccaggctgcccagcacccctcccgctgccagactcctgctgccaggcctgcaaagatgaggcaagtgagcaatcggatgaagaggacagtgtgcagtcgctccatggggtgagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagcctgtgtgcatggcgggaagacgtactcccacggggaggtgtggcacccggccttccgtgccttcggccccttgccctgcatcctatgcacctgtgaggatggccgccaggactgccagcgtgtgacctgtcccaccgagtacccctgccgtcaccccgagaaagtggctgggaagtgctgcaagatttgcccagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaagatgaggaaactgaggctcagagaggtgaagtacctggcccaaggccacacagccagaggaatggacgaagaaagtggagctgttcagcctggagaagagaagactcagggggacaggactgctggcttcgtggctctgaagggctgtcccaggcagagggagcagctgtgttctgagtgaccgcaagagtcaaacaacaagcaggggctt

SEQ ID NO: 5065 - DNA, 3346 bp, synthetic construct
  misc_feature 1..3346: note = Synthetic polypeptide
  source 1..3346: mol_type = other DNA
atggggagagaccagcgcgcggtggccggccctgccctacggcggtggctgctgctggggacagtgaccgtggggttcctcgcccagagcgtcttggcgggtgtgaagaagtttgatgtgccgtgtggaggaagagattgcagtgggggctgccagtgctaccctgagaaaggtggacgtggtcagcctgggccagtgggcccccaggggtacaatgggccaccaggattacaaggattcccgggactgcagggacgtaaaggagacaagggtgaaaggggagcccccggagtaacgggacccaagggcgacgtgggagcaagaggcgtttctggattccctggtgccgatggaattcctggacacccggggcaaggtgggcccaggggaaggccgggctacgatggctgcaacggaacccagggagactcaggtccacaggggccccccggctctgaggggttcaccgggcctcccgggccccaaggaccaaaagggcagaaaggtgagccttatgcactgcctaaagaggagcgcgacagatatcggggtgaacctggagagcctggattggtcggtttccagggacctcccggccgccctgggcatgtgggacagatgggtccagttggagctccagggagaccaggaccacctggaccccctggaccaaaaggacagcaaggcaacagaggacttggtttctacggagttaagggtgaaaagggtgacgtagggcagccgggacccaacgggattccatcagacaccctccaccccatcatcgcgcccacaggagtcaccttccacccagatcagtacaagggtgaaaaaggcagtgagggggaaccaggaataagaggcatttccttgaagggagaagaaggaatcatgggctttcctggactgaggggttaccctggcttgagtggtgaaaaaggatcaccaggacagaagggaagccgaggcctggatggctatcaagggcctgatggaccccggggacccaagggagaagccggagacccagggccccctggactacctgcctactcccctcacccttccctagcaaaaggtgccagaggtgacccgggattcccaggggcccaaggggagccaggaagccagggtgagccaggagacccgggcctcccaggtccccctggcctctccatcggagatggagatcagaggagaggcctgccgggtgagatgggacccaagggcttcatcggagaccccggcatccctgcgctctacgggggcccacctggacctgatggaaagcgagggcctccaggaccccccgggctccctggaccacctggacctgatggcttcctgtttgggctgaaaggagcaaaaggaagagcaggcttccctgggcttcccggctcccctggagcccgcggaccaaaggggtggaaaggtgacgctggggaatgcagatgtacagaaggcgacgaagctatcaaaggtcttccgggactgccaggacccaagggcttcgcaggcatcaacggggagccggggaggaaaggggacagaggagaccccggccaacacggcctccctgggttcccagggctcaagggagtgcctggcaacattggtgctcccggacccaaaggagcaaaaggagattccagaacaatcacaaccaaaggtgagcggggacagcccggcgtcccaggtgtgcccgggatgaaaggtgacgatggcagcccaggccgcgatgggctcgatggattccccggcctcccaggccctcccggtgatggcatcaagggccctccaggggacccaggctatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaatagattgtgacacagatgtgaaaagggccgttggaggtgacagacaggaggccatccagccaggttgcataggagggcccaagggattgccaggcctgccaggacccccaggccccacaggtgccaaaggcctccgaggaatcccaggcttcgcaggagctgatggaggaccagggcccaggggcttgccaggagacgcaggtcgtgaagggttcccaggacccccagggttcataggaccccgaggatccaaaggtgcagtgggcctccctggcccagatggatccccaggtcccatcggcctgccagggccagatgggccccctggggaaaggggcctccctggagaagtcctgggagctcagcccgggccacggggagatgctggtgtgcctggacagcctgggcttaaaggccttcccggagacagaggcccccctggattcagaggaagccaagggatgcctgggatgccagggctgaagggccagccaggcctcccaggaccttccggccagccaggcctgtatgggcctccaggactgcatggattcccaggagctcctggccaagaggggcccttggggctgccaggaatcccaggccgtgaaggtctgcctggtgatagaggggaccctggggacacaggcgctcctggccctgtgggcatgaaaggtctctctggtgacagaggagatgctggcttcacaggggagcaaggccatccaggaagccctggatttaaaggaattgatggaatgcctgggacccccgggctaaaaggagatagaggctcacctgggatggatggtttccaaggcatgcctggactcaaagggagacccgggtttccagggagcaaaggcgaggctggatttttcggaatacccggtctgaagggtctggctggtgagccaggttttaaaggcagccgaggggaccctgggcccccaggaccacctcctgtcatcctgccaggaatgaaagacattaaaggagagaaaggagatgaagggcctatggggctgaaaggatacctgggcgcaaaaggtatccaaggaatgccaggcatcccagggctgtcaggaatccctgggctgcctgggaggcccggccacatcaaaggagtcaagggagacatcggagtccccggcatccccggtttgccaggattccctggggtggctggcccccctggaattacgggattcccaggattcataggaagccggctactggggaggccgaggcggaagaatcgctggaacccaggaggcggaggttgcagtgagccgagattgcgccgttgcactccagcttgggtgacaaagcaagactccatctcaaaaaaaagacaagaaaaaagaaaga

SEQ ID NO: 5066 - DNA, 809 bp, synthetic construct; identical to SEQ ID NO: 2110
  misc_feature 1..809: note = Synthetic polypeptide
  source 1..809: mol_type = other DNA

SEQ ID NO: 5067 - DNA, 644 bp, synthetic construct; identical to SEQ ID NO: 2111
  misc_feature 1..644: note = Synthetic polypeptide
  source 1..644: mol_type = other DNA

SEQ ID NO: 5068 - DNA, 768 bp, synthetic construct; identical to SEQ ID NO: 2112
  misc_feature 1..768: note = Synthetic polypeptide
  source 1..768: mol_type = other DNA

SEQ ID NO: 5069 - DNA, 427 bp, synthetic construct; identical to SEQ ID NO: 2113
  misc_feature 1..427: note = Synthetic polypeptide
  source 1..427: mol_type = other DNA

SEQ ID NO: 5070 - DNA, 1216 bp, synthetic construct; identical to SEQ ID NO: 1380
  misc_feature 1..1216: note = Synthetic polypeptide
  source 1..1216: mol_type = other DNA

SEQ ID NO: 5071 - DNA, 582 bp, synthetic construct; identical to SEQ ID NO: 4738
  misc_feature 1..582: note = Synthetic polypeptide
  source 1..582: mol_type = other DNA

SEQ ID NO: 5072 - DNA, 546 bp, synthetic construct; identical to SEQ ID NO: 4739
  misc_feature 1..546: note = Synthetic polypeptide
  source 1..546: mol_type = other DNA

SEQ ID NO: 5073 - DNA, 567 bp, synthetic construct; identical to SEQ ID NO: 4740
  misc_feature 1..567: note = Synthetic polypeptide
  source 1..567: mol_type = other DNA

SEQ ID NO: 5074 - DNA, 552 bp, synthetic construct; identical to SEQ ID NO: 4741
  misc_feature 1..552: note = Synthetic polypeptide
  source 1..552: mol_type = other DNA

SEQ ID NO: 5075 - DNA, 597 bp, synthetic construct; identical to SEQ ID NO: 4742
  misc_feature 1..597: note = Synthetic polypeptide
  source 1..597: mol_type = other DNA

SEQ ID NO: 5076 - DNA, 2161 bp, synthetic construct; identical to SEQ ID NO: 288
  misc_feature 1..2161: note = Synthetic polypeptide
  source 1..2161: mol_type = other DNA

SEQ ID NO: 5077 - DNA, 2140 bp, synthetic construct; identical to SEQ ID NO: 289
  misc_feature 1..2140: note = Synthetic polypeptide
  source 1..2140: mol_type = other DNA

SEQ ID NO: 5078 - DNA, 529 bp, synthetic construct; identical to SEQ ID NO: 287
  misc_feature 1..529: note = Synthetic polypeptide
  source 1..529: mol_type = other DNA

SEQ ID NO: 5079 - DNA, 344 bp, synthetic construct
  misc_feature 1..344: note = Synthetic polypeptide
  source 1..344: mol_type = other DNA
ttcttgctgcattcatcatcacctctgactggatacccctgggggtcaatagtcaacgaggagacgatgtgactcaagcgactccagaaacattcacagaagatcctaatctggtgaatgatcccgctacagatgaaacagttttggctgttttggctgatattgcaccttccacagatgacttggtttgcttgcacttgctgtccttccaccatgggatgactctcatcagatgatggcaccatgttcttggacttctcagcctccagaactgtgagaaataaatttcttttctttataaattactcagttggtgacagactcaataacacaaaatagactaa

SEQ ID NO: 5080 - DNA, 375 bp, synthetic construct
  misc_feature 1..375: note = Synthetic polypeptide
  source 1..375: mol_type = other DNA
atgtcgctcttgggacccaaggtgctgctgtttcttgctgcattcatcatcacctctgactggatacccctgggggtcaatagtcaacgaggagacgatgtgactcaagcgactccagaaacattcacagaagatcctaatctggtgaatgatcccgctacagatgaaacagttttggctgttttggctgatattgcaccttccacagatgacttggtttgcttgcacttgctgtccttccaccatgggatgactctcatcagatgatggcaccatgttcttggacttctcagcctccagaactgtgagaaataaatttcttttctttataaattactcagttggtgacagactcaataacacaaaatagactaa

SEQ ID NO: 5081 - DNA, 339 bp, synthetic construct
  misc_feature 1..339: note = Synthetic polypeptide
  source 1..339: mol_type = other DNA
atgtcgctcttgggacccaaggtgctgctgtttcttgctgcattcatcatcacctctgacgatgtgactcaagcgactccagaaacattcacagaagatcctaatctggtgaatgatcccgctacagatgaaacagttttggctgttttggctgatattgcaccttccacagatgacttggtttgcttgcacttgctgtccttccaccatgggatgactctcatcagatgatggcaccatgttcttggacttctcagcctccagaactgtgagaaataaatttcttttctttataaattactcagttggtgacagactcaataacacaaaatagactaa

SEQ ID NO: 5082 - DNA, 798 bp, synthetic construct; identical to SEQ ID NO: 3839
  misc_feature 1..798: note = Synthetic polypeptide
  source 1..798: mol_type = other DNA

SEQ ID NO: 5083 - DNA, 110 bp, synthetic construct
  misc_feature 1..110: note = Synthetic polypeptide
  source 1..110: mol_type = other DNA
atggctgtgcaacgccgtctagatgtcatggaggaggcattattctgagaagaggtctgtaggcttcaccacactgccaatggggtccatggcatacacagggaaaaacc

SEQ ID NO: 5084 - DNA, 236 bp, synthetic construct
  misc_feature 1..236: note = Synthetic polypeptide
  source 1..236: mol_type = other DNA
atgcggcccctgctctgcgcgctgaccggactggccctgctccgcgccgcgggctctttggccgctgccgaacccttcagccctccgcgaggagactcagctcagagcacagcgtgtgacagacacatggctgtgcaacgccgtctagatgtcatggaggaggcattattctgagaagaggtctgtaggcttcaccacactgccaatggggtccatggcatacacagggaaaaacc

SEQ ID NO: 5085 - DNA, 465 bp, synthetic construct; identical to SEQ ID NO: 3964
  misc_feature 1..465: note = Synthetic polypeptide
  source 1..465: mol_type = other DNA

SEQ ID NO: 5086 - DNA, 1206 bp, synthetic construct; identical to SEQ ID NO: 282
  misc_feature 1..1206: note = Synthetic polypeptide
  source 1..1206: mol_type = other DNA

SEQ ID NO: 5087 - DNA, 1209 bp, synthetic construct; identical to SEQ ID NO: 281
  misc_feature 1..1209: note = Synthetic polypeptide
  source 1..1209: mol_type = other DNA

SEQ ID NO: 5088 - DNA, 1203 bp, synthetic construct; identical to SEQ ID NO: 286
  misc_feature 1..1203: note = Synthetic polypeptide
  source 1..1203: mol_type = other DNA

SEQ ID NO: 5089 - DNA, 1834 bp, synthetic construct; identical to SEQ ID NO: 133
  misc_feature 1..1834: note = Synthetic polypeptide
  source 1..1834: mol_type = other DNA

SEQ ID NO: 5090 - DNA, 1765 bp, synthetic construct; identical to SEQ ID NO: 135
  misc_feature 1..1765: note = Synthetic polypeptide
  source 1..1765: mol_type = other DNA

SEQ ID NO: 5091 - DNA, 884 bp, synthetic construct; identical to SEQ ID NO: 2542
  misc_feature 1..884: note = Synthetic polypeptide
  source 1..884: mol_type = other DNA

SEQ ID NO: 5092 - DNA, 1673 bp, synthetic construct; identical to SEQ ID NO: 2326
  misc_feature 1..1673: note = Synthetic polypeptide
  source 1..1673: mol_type = other DNA

SEQ ID NO: 5093 - DNA, 995 bp, synthetic construct
  misc_feature 1..995: note = Synthetic polypeptide
  source 1..995: mol_type = other DNA
atgatcatcaccaaggccggcaggcgcatgtttccagcaatgagagtgaagatctctggattagatcctcaccagcaatattacattgccatggatattgtaccagtggacaacaaaagatacaggtatgtttaccacagttcgaaatggatggtggcaggtaatgctgactcgcctgtgccaccccgtgtgtacattcatccagactcgcctgcctcgggggagacttggatgagacaagttatcagcttcgacaagctgaagctcaccaacaatgaactggatgaccaaggccatattattcttcattctatgcacaaataccaaccgcgagtgcacgtcatccgtaaagactgtggagacgatctttctcccatcaagcctgttccatccggggagggagtaaaggcattctcctttccagaaactgtcttcacaaccgtcactgcctatcagaatcagcagattactcgcctgaagatagataggaatccatttgctaaaggcttccgagactccgggcgcaacagaatgggtttggaagccttggtggaatcatatgcattctggcgaccatcactacggactctgacctttgaagatatccctggaattcccaagcaagatgacactctcaccagtgccatgacagttgataatcaccatgacaacaactggaagaagtcataaaaggaaaaaaggaagacagcactactggttcagagaagtttaccaccctattctggaaaaggcatgaatattgctccctttgcttttactgtacaaacccttcattaaagagactctatattttaacctcgtcatccttcactagttgagaagttgatttgcaagccacattcccacttctctattccctggctattgaataaatcttgctttgcttgatgctcacttttggtttcatgtatttgctctgcaatacgtaattggaaacatcccatcttttggggctaccgggctttttagtaata

SEQ ID NO: 5094 - DNA, 1469 bp, synthetic construct
  misc_feature 1..1469: note = Synthetic polypeptide
  source 1..1469: mol_type = other DNA
atggccgagaagcgaaggggctcgccgtgcagcatgctaagcctcaaggcgcacgctttctcggtggaggcgctgatcggcgccgagaagcagcaacagcttcagaagaagcggcgaaaactgggcgccgaagaggcggcgggggccgtggacgacggaggctgcagccgcggcggcggcgcgggcgaaaagggttcttctgagggagacgaaggcgctgcgctcccgccgccggctggggcgacgtctgggccggctcggagtggcgcagacctggagcgcggagccgcgggcggctgtgaggacggcttccagcagggagcttcccctctggcgtcaccgggaggctcccccaaggggtctccggcgcgctccctggcccggcccgggacccctctgccctcgccgcaggccccgcgggtggatctgcagggagccgagctctggaagcgctttcatgagataggcactgagatgatcatcaccaaggccggcaggcgcatgtttccagcaatgagagtgaagatctctggattagatcctcaccagcaatattacattgccatggatattgtaccagtggacaacaaaagatacaggtatgtttaccacagttcgaaatggatggtggcaggtaatgctgactcgcctgtgccaccccgtgtgtacattcatccagactcgcctgcctcgggggagacttggatgagacaagttatcagcttcgacaagctgaagctcaccaacaatgaactggatgaccaaggccatattattcttcattctatgcacaaataccaaccgcgagtgcacgtcatccgtaaagactgtggagacgatctttctcccatcaagcctgttccatccggggagggagtaaaggcattctcctttccagaaactgtcttcacaaccgtcactgcctatcagaatcagcagattactcgcctgaagatagataggaatccatttgctaaaggcttccgagactccgggcgcaacagaatgggtttggaagccttggtggaatcatatgcattctggcgaccatcactacggactctgacctttgaagatatccctggaattcccaagcaagatgacactctcaccagtgccatgacagttgataatcaccatgacaacaactggaagaagtcataaaaggaaaaaaggaagacagcactactggttcagagaagtttaccaccctattctggaaaaggcatgaatattgctccctttgcttttactgtacaaacccttcattaaagagactctatattttaacctcgtcatccttcactagttgagaagttgatttgcaagccacattcccacttctctattccctggctattgaataaatcttgctttgcttgatgctcacttttggtttcatgtatttgctctgcaatacgtaattggaaacatcccatcttttggggctaccgggctttttagtaata

SEQ ID NO: 5095 - DNA, 2084 bp, synthetic construct
  misc_feature 1..2084: note = Synthetic polypeptide
  source 1..2084: mol_type = other DNA
atggagacttcccttagcctggagagtggccatcatgggtcttacaggagaggggaccgtcctgggctggcctggaccatggtgctgctctgggagcctgcaggagcctggcttgctctgggcctggccctggccctgggccccagcgtggccgcagctgcccctcggcaggactgcacgggcgtggagtgcccgccgctggagaactgcattgaggaggcgctggagccgggtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggcctgccactgccctgacgccggtggagagctcatctgctaccagctccccggttgccacgggaacttctcagatgccgaggagggtgaccccgagcgacactacgaagacccctacagctatgaccaggaggtggccgaggtggaagcagcaacagccctggggggtgaggtccaggcgggtgcagtccaggcaggcgcagggggccccccagctgctctgggaggtgggagtcagccactgtccaccatccaggcacccccctggccagctgtcctccccaggcccacagcggctgctgccctgggtcccccagccccagtgcaggccaaagctaggagagtgaccgaggacagtgaggaggaagaagaggaggaggaggagagagaggaaatggctgtcactgagcagctggcagcaggtggccacagggggctggatgggctgcccactacagccccagctggacccagtcttcctatccaggaggagagggcagaagctggggcaagggcagaagctggggcaaggcctgaagagaacctcatcctggatgcccaagccacgtcccgcagcactgggccggagggcgtgacgcatgcaccgagcctgggcaaggctgctctcgtcccaactcaggccgtgcctggctctcccagggacccagtcaagcccagcccccacaacatcctgtccacatcactgcctgatgcagcctggatcccacccacccgagaagtgcccaggaagccgcaagttctgccccattcccacgtggaggaggacacagaccccaactctgtccattctatccccagaagtagccctgaaggctccaccaaggacctgatcgagacttgctgcgcagccggacagcagtgggccattgacaatgacgagtgcctggagatccctgagagtggcactgaggacaacgtctgcaggacagcccagaggcactgctgtgtctcctacttgcaggagaagagctgcatggccggcgtcctgggagccaaggagggtgagacctgtggggctgaggacaacgacagctgcggcatctccctgtacaagcaatgctgtgactgctgtggcctgggcctccgcgtgcgggccgagggccagtcgtgtgagtccaatcctaacctgggctatccctgcaatcatgtcatgctctcctgctgtgagggtgaagagcctctcatagtacctgaggttcgccgacctccagagcccgcagctgcaccacggagagtttcagaggcagagatggcgggccgagaggccctgtcactgggcacagaggccgagctgccgaacagcctgccgggcgatgaccaggatgagtgccttctcctcccgggagagctgtgccagcacctttgcatcaatactgtgggttcttaccactgtgcctgctttcctggcttctcactgcaggacgatggccgcacttgccgcccagctgagattgatctttcccaaggtatatgcacactccaaacctcattttcctctcctgtgaaatgggg

SEQ ID NO: 5096 - DNA, 2006 bp, synthetic construct
  misc_feature 1..2006: note = Synthetic polypeptide
  source 1..2006: mol_type = other DNA
atggtgctgctctgggagcctgcaggagcctggcttgctctgggcctggccctggccctgggccccagcgtggccgcagctgcccctcggcaggactgcacgggcgtggagtgcccgccgctggagaactgcattgaggaggcgctggagccgggtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggcctgccactgccctgacgccggtggagagctcatctgctaccagctccccggttgccacgggaacttctcagatgccgaggagggtgaccccgagcgacactacgaagacccctacagctatgaccaggaggtggccgaggtggaagcagcaacagccctggggggtgaggtccaggcgggtgcagtccaggcaggcgcagggggccccccagctgctctgggaggtgggagtcagccactgtccaccatccaggcacccccctggccagctgtcctccccaggcccacagcggctgctgccctgggtcccccagccccagtgcaggccaaagctaggagagtgaccgaggacagtgaggaggaagaagaggaggaggaggagagagaggaaatggctgtcactgagcagctggcagcaggtggccacagggggctggatgggctgcccactacagccccagctggacccagtcttcctatccaggaggagagggcagaagctggggcaagggcagaagctggggcaaggcctgaagagaacctcatcctggatgcccaagccacgtcccgcagcactgggccggagggcgtgacgcatgcaccgagcctgggcaaggctgctctcgtcccaactcaggccgtgcctggctctcccagggacccagtcaagcccagcccccacaacatcctgtccacatcactgcctgatgcagcctggatcccacccacccgagaagtgcccaggaagccgcaagttctgccccattcccacgtggaggaggacacagaccccaactctgtccattctatccccagaagtagccctgaaggctccaccaaggacctgatcgagacttgctgcgcagccggacagcagtgggccattgacaatgacgagtgcctggagatccctgagagtggcactgaggacaacgtctgcaggacagcccagaggcactgctgtgtctcctacttgcaggagaagagctgcatggccggcgtcctgggagccaaggagggtgagacctgtggggctgaggacaacgacagctgcggcatctccctgtacaagcaatgctgtgactgctgtggcctgggcctccgcgtgcgggccgagggccagtcgtgtgagtccaatcctaacctgggctatccctgcaatcatgtcatgctctcctgctgtgagggtgaagagcctctcatagtacctgaggttcgccgacctccagagcccgcagctgcaccacggagagtttcagaggcagagatggcgggccgagaggccctgtcactgggcacagaggccgagctgccgaacagcctgccgggcgatgaccaggatgagtgccttctcctcccgggagagctgtgccagcacctttgcatcaatactgtgggttcttaccactgtgcctgctttcctggcttctcactgcaggacgatggccgcacttgccgcccagctgagattgatctttcccaaggtatatgcacactccaaacctcattttcctctcctgtgaaatgggg

SEQ ID NO: 5097 - DNA, 671 bp, synthetic construct; identical to SEQ ID NO: 2375
  misc_feature 1..671: note = Synthetic polypeptide
  source 1..671: mol_type = other DNA

SEQ ID NO: 5098 - DNA, 353 bp, synthetic construct; identical to SEQ ID NO: 2376
  misc_feature 1..353: note = Synthetic polypeptide
  source 1..353: mol_type = other DNA

SEQ ID NO: 5099 - DNA, 775 bp, synthetic construct; identical to SEQ ID NO: 215
  misc_feature 1..775: note = Synthetic polypeptide
  source 1..775: mol_type = other DNA

SEQ ID NO: 5100 - DNA, 1400 bp, synthetic construct
  misc_feature 1..1400: note = Synthetic polypeptide
  source 1..1400: mol_type = other DNA
atggctctggcccgaggcagccggcagctgggggccctggtgtggggcgcctgcctgtgcgtgctggtgcacgggcagcaggcgcagcccgggcagggctcggaccccgcccgctggcggcagctgatccagtgggagaacaacgggcaggtgtacagcttgctcaactcgggctcagagtacgtgccggccggacctcagcgctccgagagtagctcccgggtgctgctggccggcgcgccccaggcccagcagcggcgcagccacgggagcccccggcgtcggcaggcgccgtccctgcccctgccggggcgcgtgggctcggacaccgtgcgcggccaggcgcggcacccattcggctttggccaggtgcccgacaactggcgcgaggtggccgtcggggacagcacgggcatggcccgggcccgcacctccgtctcccagcaacggcacgggggctccgcctcctcggtctcggcttcggccttcgccagcacctaccgccagcagccctcctacccgcagcagttcccctacccgcaggcgcccttcgtcagccagtacgagaactacgaccccgcgtcgcggacctacgaccagggtttcgtgtactaccggcccgcgggcggcggcgtgggcgcgggggcggcggccgtggcctcggcgggggtcatctacccctaccagccccgggcgcgctacgaggagtacggcggcggcgaagagctgcccgagtacccgcctcagggcttctacccggcccccgagaggccctacgtgccgccgccgccgccgccccccgacggcctggaccgccgctactcgcacagtctgtacagcgagggcacccccggcttcgagcaggcctaccctgaccccggtcccgaggcggcgcaggcccatggcggagacccacgcctgggctggtacccgccctacgccaacccgccgcccgaggcgtacgggccgccgcgcgcgctggagccgccctacctgccggtgcgcagctccgacacgcccccgccgggtggggagcggaacggcgcgcagcagggccgcctcagcgtgggcagcgtgtaccggcccaaccagaacggccgcgtaactcctgctcagactcctgcatgcccagggaggaaggtggaggggcaggaacaggacggacaggccccgggctctggcacatcctggggaacaagggaccacaaggacgggggcagtctccagacttcccctgggcgcttgaccccaggccttgcaggggagagagccagggcctccctcaggtctttgttcatgctgttttccctgccgtggacaccctttcccgctctctgattctctaaatcctgccccatctcccagatcttgttcatgtccaagcttttccaggaagtctt

SEQ ID NO: 5101 - DNA, 1989 bp, synthetic construct
  misc_feature 1..1989: note = Synthetic polypeptide
  source 1..1989: mol_type = other DNA
atggccaagcctcggctgctagttctctacttcgctctgattgtggttccggcctgggtgtccagcattgtcctcacagggacaagcgagcccccagatgcgcagacagtggcgcctgcggaggacgagactctgcaaaacgaggcggacaaccaggagaacgttttatctcagttgctgggggactatgacaaggtcaaggctatgtctgagggctcggactgtcagtgcaagtgtgtggtgagacccctgggccgggatgcctgccagaggatcaatgcgggggcctccaggaaggaagacttctataccgtggaaaccatcacctcaggctcgtcgtgcaagtgtgcctgtgtagcacccccatcggccctcaatccctgcgagggagacttcaggctccagaagctgcgggaggcagacagccaggacttgaagctctccacaatcatagacatgttggaaggagcgttctatggcctggatctcctgaagctacattcagtcaccaccaaactggtggggcgagtggataaactggaggaggaagtgtctaaaaacctcaccaaggaaaatgaacaaatcaaagaggacatggaagaaattcgaaccgagatgaataagcgaggcaaagaaaattgctctgaaaacatcctagatagcatgccagacatccgctcagccctgcagagggatgcagcagcagcctacgcccacccagagtatgaagagcggtttctgcaggaagaaaccgtgtcccagcagatcaactccatcgaacttctgcagacgcgacccctggctctgcctgaggtggtgaagtcacagcggcccctgcagaggcaggtccacctgagaggccggccggcctcccagcccactgtcatccggggcatcacctactataaagccaaggtctctgaagaagagaatgacattgaagagcagcaagatgagtttttcagcggtgacaatggagtggatttgctgattgaagatcagctcctgagacacaacggcctgatgaccagtgtcacccggaggcctgcagccacccgtcagggacacagcactgctgtgacaagcgacctgaacgctcggaccgcaccctggtcctcagcactgccacagccctcgacctcagatcccagcatcgccaaccatgcctcagtgggaccaacactccaaacaacctcggtgtctccagatcccacaagggagtcagtcctgcagccttctcctcaggtaccagccaccactgtggcccacacagccacccagcaaccagcagccccagctcctccggcagtgtctcccagggaggcattgatggaagctatgcacacagtcccagtgcctcccaccacagtcagaacagactcgctggggaaagatgctcctgctgggtggggaacaacccctgccagccccacgctgagccccgaagaagaagatgacatccggaatgtcatagaggtgaagaagctgcagaaaaaagtctgaagctaacagaggctggttcgtgagatttagagaaagaagttgtctccataatgtaaaaatgcaagtgaaatagcaagtgctaatgcagaagctgtagcaagttatctagaagatctagctaagattgttgatgaaggtggctacactaaacaacagattttcagtgtaggcaaaacagccatccattggaagaaggtgccatctaggaccttcataattaaagaggagaggtcagtgcctggcttcaaagcttcaaaggacaaggtgactcttctgttaggggctaatgcagctggtgactttaaatcaaagccagtgctcatttaccattctaaaaatcctagggcccttaagaattatgcaaatctactctcctggtgctctatacatggaacaacaaagcttggataatagcacatctttttacagcatggtttactgaataatttaagccctttgttgagacctactgctcagaaaaagaaa

SEQ ID NO: 5102 - DNA, 1992 bp, synthetic construct
  misc_feature 1..1992: note = Synthetic polypeptide
  source 1..1992: mol_type = other DNA
atggccaagcctcggctgctagttctctacttcgctctgattgtggttccggcctgggtgtccagcattgtcctcacagggacaagcgagcccccagatgcgcagacagtggcgcctgcggaggacgagactctgcaaaacgaggcggacaaccaggagaacgttttatctcagttgctgggggactatgacaaggtcaaggctatgtctgagggctcggactgtcagtgcaagtgtgtggtgagacccctgggccgggatgcctgccagaggatcaatgcgggggcctccaggaaggaagacttctataccgtggaaaccatcacctcaggctcgtcgtgcaagtgtgcctgtgtagcacccccatcggccctcaatccctgcgagggagacttcaggctccagaagctgcgggaggcagacagccaggacttgaagctctccacaatcatagacatgttggaaggagcgttctatggcctggatctcctgaagctacattcagtcaccaccaaactggtggggcgagtggataaactggaggaggaagtgtctaaaaacctcaccaaggaaaatgaacaaatcaaagaggacatggaagaaattcgaaccgagatgaataagcgaggcaaagaaaattgctctgaaaacatcctagatagcatgccagacatccgctcagccctgcagagggatgcagcagcagcctacgcccacccagagcagtatgaagagcggtttctgcaggaagaaaccgtgtcccagcagatcaactccatcgaacttctgcagacgcgacccctggctctgcctgaggtggtgaagtcacagcggcccctgcagaggcaggtccacctgagaggccggccggcctcccagcccactgtcatccggggcatcacctactataaagccaaggtctctgaagaagagaatgacattgaagagcagcaagatgagtttttcagcggtgacaatggagtggatttgctgattgaagatcagctcctgagacacaacggcctgatgaccagtgtcacccggaggcctgcagccacccgtcagggacacagcactgctgtgacaagcgacctgaacgctcggaccgcaccctggtcctcagcactgccacagccctcgacctcagatcccagcatcgccaaccatgcctcagtgggaccaacactccaaacaacctcggtgtctccagatcccacaagggagtcagtcctgcagccttctcctcaggtaccagccaccactgtggcccacacagccacccagcaaccagcagccccagctcctccggcagtgtctcccagggaggcattgatggaagctatgcacacagtcccagtgcctcccaccacagtcagaacagactcgctggggaaagatgctcctgctgggtggggaacaacccctgccagccccacgctgagccccgaagaagaagatgacatccggaatgtcatagaggtgaagaagctgcagaaaaaagtctgaagctaacagaggctggttcgtgagatttagagaaagaagttgtctccataatgtaaaaatgcaagtgaaatagcaagtgctaatgcagaagctgtagcaagttatctagaagatctagctaagattgttgatgaaggtggctacactaaacaacagattttcagtgtaggcaaaacagccatccattggaagaaggtgccatctaggaccttcataattaaagaggagaggtcagtgcctggcttcaaagcttcaaaggacaaggtgactcttctgttaggggctaatgcagctggtgactttaaatcaaagccagtgctcatttaccattctaaaaatcctagggcccttaagaattatgcaaatctactctcctggtgctctatacatggaacaacaaagcttggataatagcacatctttttacagcatggtttactgaataatttaagccctttgttgagacctactgctcagaaaaagaaa

SEQ ID NO: 5103 - DNA, 5286 bp, synthetic construct
  misc_feature 1..5286: note = Synthetic polypeptide
  source 1..5286: mol_type = other DNA
atgagcaagagacgcatgagcgtgggtcagcaaacatgggctcttctctgcaagaactgtctcaaaaaatggagaatgaaaagacagaccttgttggaatggctcttttcatttcttctggtactgtttctgtacctatttttctccaatttacatcaagttcatgacactcctcaaatgtcttcaatggatctgggacgtgtagatagttttaatgatactaattatgttattgcatttgcacctgaatccaaaactacccaagagataatgaacaaagtggcttcagccccattcctaaaaggaagaacaatcatggggtggcctgatgaaaaaagcatggatgaattggatttgaactattcaatagacgcagtgagagtcatctttactgataccttctcctaccatttgaagttttcttggggacatagaatccccatgatgaaagagcacagagaccattcagctcactgtcaagcagtgaatgaaaaaatgaagtgtgaaggttcagagttctgggagaaaggctttgtagcttttcaagctgccattaatgctgctatcatagaaatcgcaacaaatcattcagtgatggaacagctgatgtcagttactggtgtacatatgaagatattaccttttgttgcccaaggaggagttgcaactgattttttcattttcttttgcattatttctttttctacatttatatactatgtatcagtcaatgttacacaagaaagacaatacattacgtcattgatgacaatgatgggactccgagagtcagcattctggctttcctggggtttgatgtatgctggcttcatccttatcatggccactttaatggctcttattgtaaaatctgcacaaattgtcgtcctgactggttttgtgatggtcttcaccctctttctcctctatggcctgtctttgataactttagctttcctgatgagtgtgttgataaagaaacctttccttacgggcttggttgtgtttctccttattgtcttttgggggatcctgggattcccagcattgtatacacgtcttcctgcatttttggaatggactttgtgtcttcttagcccctttgccttcactgttgggatggcccagcttatacatttggactatgatgtgaattctaatgcccacttggattcttcacaaaatccatacctcataatagctactcttttcatgttggtttttgacacccttctgtatttggtattgacattatattttgacaaaattttgcccgctgaatatggacatcgatgttctcccttgtttttcctgaaatcctgtttttggtttcaacacggaagggctaatcatgtggtccttgagaatgaaacagattctgatcctacacctaatgactgttttgaaccagtgtctccagaattctgtgggaaagaagccatcagaatcaaaaatcttaaaaaagaatatgcagggaagtgtgagagagtagaagctttgaaaggtgtggtgtttgacatatatgaaggccagatcactgccctccttggtcacagtggagctggaaaaactaccctgttaaacatacttagtgggttgtcagttccaacatcaggttcagtcactgtctataatcacacactttcaagaatggctgatatagaaaatatcagcaagttcactggattttgtccacaatccaatgtgcaatttggatttctcactgtgaaagaaaacctcaggctgtttgctaaaataaaagggattttgccacatgaagtggagaaagaggtacaacgagttgtacaggaattagaaatggaaaatattcaagacatccttgctcaaaacttaagtggtggacaaaataggaaactaacttttgggattgccattttaggagatcctcaagttttgctattggatgaaccgactgctggattggatcctctttcaaggcaccgaatatggaatctcctgaaagaggggaaatcagacagagtaattctcttcagcacccagtttatagatgaggctgacattctggcggacaggaaggtgttcatatccaatgggaagctgaagtgtgcaggctcttctctgttccttaagaagaaatggggcataggctaccatttaagtttgcatctgaatgaaaggtgtgatccagagagtataacatcactggttaagcagcacatctctgatgccaaattgacagcacaaagtgaagaaaaacttgtatatattttgcctttggaaaggacaaacaaatttccagaactttacagggatcttgatagatgttctaaccaaggcattgaggattatggtgtttccataacaactttgaatgaggtgtttctgaaattagaaggaaaatcaactattgatgaatcagatattggaatttggggacaattacaaactgatggggcaaaagatataggaagccttgttgagctggaacaagttttgtcttccttccacgaaacaaggaaaacaatcagtggcgtggcgctctggaggcagcaggtctgtgcaatagcaaaagttcgcttcctaaagttaaagaaagaaagaaaaagcctgtggactatattattgctttttggtattagctttatccctcaacttttggaacatctattctacgagtcatatcagaaaagttacccgtgggaactgtctccaaatacatacttcctctcaccaggacaacaaccacaggatcctctgacccatttactggtcatcaataagacagggtcaaccattgataactttttacattcactgaggcgacagaacatagctatagaagtggatgcctttggaactagaaatggcacagatgacccatcttacaatggtgctatcattgtgtcaggtgatgaaaaggatcacagattttcaatagcatgtaatacaaaacggctgaattgctttcctgtcctcctggatgtcattagcaatggactacttggaatttttaattcgtcagaacacattcagactgacagaagcacattttttgaagagcatatggattatgagtatgggtaccgaagtaacaccttcttctggataccgatggcagcctctttcactccatacattgcaatgagcagcattggtgactacaaaaaaaaagctcattcccagctacggatttcaggcctctacccttctgcatactggtttggccaagcactggtggatgtttccctgtactttttgatcctcctgctaatgcaaataatggattatatttttagcccagaggagattatatttataattcaaaacctgttaattcaaatcctgtgtagtattggctatgtctcatctcttgttttcttgacatatgtgatttcattcatttttcgcaatgggagaaaaaatagtggcatttggtcatttttcttcttaattgtggtcatcttctcgatagttgctactgatctaaatgaatatggatttctagggctattttttggcaccatgttaatacctcccttcacattgattggctctctattcattttttctgagatttctcctgattccatggattacttaggagcttcagaatctgaaattgtatacctggcactgctaataccttaccttcattttctcatttttcttttcattctgcgatgcctagaaatgaactgcaggaagaaactaatgagaaaggatcctgtgttcagaatttctccaagaagcaacgctatttttccaaacccagaagagcctgaaggagaggaggaagatatccagatggaaagaatgagaacagtgaatgctatggctgtgcgagactttgatgagacacccgtcatcattgccagctgtctacggaaggaatatgcaggcaaaaagaaaaattgcttttctaaaaggaagaaaaaaattgccacaagaaatgtctctttttgtgttaaaaaaggtgaagttataggactgttaggacacaatggagctggtaaaagtacaactattaagatgataactggagacacaaaaccaactgcaggacaggtgattttgaaagggagcggtggaggggaacccctgggcttcctggggtactgccctcaggagaatgcgctgtggcccaacctgacagtgaggcagcacctggaggtgtacgctgccgtgaaaggtctcaggaaaggggacgcaatgatcgccatcacacggttagtggatgcgctcaagctgcaggaccagctgaaggctcccgtgaagaccttgtcagagggaataaagcgaaagctgtgctttgtgctgagcatcctggggaacccgtcagtggtgcttctggatgagccgtcgaccgggatggaccccgaggggcagcagcaaatgtggcaggtgattcgggccacctttagaaacacggagaggggcgccctcctgaccacccactacatggcagaggctgaggcggtgtgtgaccgagtggccatcatggtgtcaggaaggctgagatgtattggttccatccaacacctgaaaagcaaatttggcaaagactacctgctggagatgaagctgaagaacctggcacaaatggagcccctccatgcagagatcctgaggcttttcccccaggctgctcagcaggaaaggttctcctccctgatggtctataagttgcctgttgaggatgtgcgacctttatcacaggctttcttcaaattagagatagttaaacagagtttcgacctggaggagtacagcctctcacagtctaccctggagcaggttttcctggagctctccaaggagcaggagctgggtgatcttgaagaggactttgatccctcgcactgtttacaatagcaaagacttggaaccaaccaaaatacccacaaatgatagaccggataaagaaaacgtgacacatatacaccatggaatactatgcagccatagaaaaggatgagttcatattcttcacagggacatggatgaagctggaaaccatcatcctcagcaaactaacacaggaacagaaaaccaaacaccgcatgttctcactcataagtgggaattgaacaatgagaatacatggacacagggaggggaacaccacaccctggggcctgttggggggatgggggctaggggagggatagcattaggagaaatacctgatgtagatgatgggttgatgggtgcagcaaagtaccatggcacatgtatacctgtgtaacaaacctgcacattcagcacatgtatcccagaacttaaagtataataaaaataaataaa

SEQ ID NO: 5104 - DNA, 5172 bp, synthetic construct
  misc_feature 1..5172: note = Synthetic polypeptide
  source 1..5172: mol_type = other DNA
atgagcaagagacgcatgagcgtgggtcagcaaacatgggctcttctctgcaagaactgtctcaaaaaatggagaatgaaaagacagaccttgttggaatggctcttttcatttcttctggtactgtttctgtacctatttttctccaatttacatcaagttcatgacactcctcaaatgtcttcaatggatctgggacgtgtagatagttttaatgatactaattatgttattgcatttgcacctgaatccaaaactacccaagagataatgaacaaagtggcttcagccccattcctaaaaggaagaacaatcatggggtggcctgatgaaaaaagcatggatgaattggatttgaactattcaatagacgcagtgagagtcatctttactgataccttctcctaccatttgaagttttcttggggacatagaatccccatgatgaaagagcacagagaccattcagctcactgtcaagcagtgaatgaaaaaatgaagtgtgaaggttcagagttctgggagaaaggctttgtagcttttcaagctgccattaatgctgctatcatagaaatcgcaacaaatcattcagtgatggaacagctgatgtcagttactggtgtacatatgaagatattaccttttgttgcccaaggaggagttgcaactgattttttcattttcttttgcattatttctttttctacatttatatactatgtatcagtcaatgttacacaagaaagacaatacattacgtcattgatgacaatgatgggactccgagagtcagcattctggctttcctggggtttgatgtatgctggcttcatccttatcatggccactttaatggctcttattgtaaaatctgcacaaattgtcgtcctgactggttttgtgatggtcttcaccctctttctcctctatggcctgtctttgataactttagctttcctgatgagtgtgttgataaagaaacctttccttacgggcttggttgtgtttctccttattgtcttttgggggatcctgggattcccagcattgtatacacgtcttcctgcatttttggaatggactttgtgtcttcttagcccctttgccttcactgttgggatggcccagcttatacatttggactatgatgtgaattctaatgcccacttggattcttcacaaaatccatacctcataatagctactcttttcatgttggtttttgacacccttctgtatttggtattgacattatattttgacaaaattttgcccgctgaatatggacatcgatgttctcccttgtttttcctgaaatcctgtttttggtttcaacacggaagggctaatcatgtggtccttgagaatgaaacagattctgatcctacacctaatgactgttttgaaccagtgtctccagaattctgtgggaaagaagccatcagaatcaaaaatcttaaaaaagaatatgcagggaagtgtgagagagtagaagctttgaaaggtgtggtgtttgacatatatgaaggccagatcactgccctccttggtcacagtggagctggaaaaactaccctgttaaacatacttagtgggttgtcagttccaacatcaggttcagtcactgtctataatcacacactttcaagaatggctgatatagaaaatatcagcaagttcactggattttgtccacaatccaatgtgcaatttggatttctcactgtgaaagaaaacctcaggctgtttgctaaaataaaagggattttgccacatgaagtggagaaagaggtacaacgagttgtacaggaattagaaatggaaaatattcaagacatccttgctcaaaacttaagtggtggacaaaataggaaactaacttttgggattgccattttaggagatcctcaagttttgctattggatgaaccgactgctggattggatcctctttcaaggcaccgaatatggaatctcctgaaagaggggaaatcagacagagtaattctcttcagcacccagtttatagatgaggctgacattctggcggacaggaaggtgttcatatccaatgggaagctgaagtgtgcaggctcttctctgttccttaagaagaaatggggcataggctaccatttaagtttgcatctgaatgaaaggtgtgatccagagagtataacatcactggttaagcagcacatctctgatgccaaattgacagcacaaagtgaagaaaaacttgtatatattttgcctttggaaaggacaaacaaatttccagaactttacagggatcttgatagatgttctaaccaaggcattgaggattatggtgtttccataacaactttgaatgaggtgtttctgaaattagaaggaaaatcaactattgatgaatcagatattggaatttggggacaattacaaactgatggggcaaaagatataggaagccttgttgagctggaacaagttttgtcttccttccacgaaacaaggaaaacaatcagtggcgtggcgctctggaggcagcaggtctgtgcaatagcaaaagttcgcttcctaaagttaaagaaagaaagaaaaagcctgtggactatattattgctttttggtattagctttatccctcaacttttggaacatctattctacgagtcatatcagaaaagttacccgtgggaactgtctccaaatacatacttcctctcaccaggacaacaaccacaggatcctctgacccatttactggtcatcaataagacagggtcaaccattgataactttttacattcactgaggcgacagaacatagctatagaagtggatgcctttggaactagaaatggcacagatgacccatcttacaatggtgctatcattgtgtcaggtgatgaaaaggatcacagattttcaatagcatgtaatacaaaacggctgaattgctttcctgtcctcctggatgtcattagcaatggactacttggaatttttaattcgtcagaacacattcagactgacagaagcacattttttgaagagcatatggattatgagtatgggtaccgaagtaacaccttcttctggataccgatggcagcctctttcactccatacattgcaatgagcagcattggtgactacaaaaaaaaagctcattcccagctacggatttcaggcctctacccttctgcatactggtttggccaagcactggtggatgtttccctgtactttttgatcctcctgctaatgcaaataatggattatatttttagcccagaggagattatatttataattcaaaacctgttaattcaagtggtcatcttctcgatagttgctactgatctaaatgaatatggatttctagggctattttttggcaccatgttaatacctcccttcacattgattggctctctattcattttttctgagatttctcctgattccatggattacttaggagcttcagaatctgaaattgtatacctggcactgctaataccttaccttcattttctcatttttcttttcattctgcgatgcctagaaatgaactgcaggaagaaactaatgagaaaggatcctgtgttcagaatttctccaagaagcaacgctatttttccaaacccagaagagcctgaaggagaggaggaagatatccagatggaaagaatgagaacagtgaatgctatggctgtgcgagactttgatgagacacccgtcatcattgccagctgtctacggaaggaatatgcaggcaaaaagaaaaattgcttttctaaaaggaagaaaaaaattgccacaagaaatgtctctttttgtgttaaaaaaggtgaagttataggactgttaggacacaatggagctggtaaaagtacaactattaagatgataactggagacacaaaaccaactgcaggacaggtgattttgaaagggagcggtggaggggaacccctgggcttcctggggtactgccctcaggagaatgcgctgtggcccaacctgacagtgaggcagcacctggaggtgtacgctgccgtgaaaggtctcaggaaaggggacgcaatgatcgccatcacacggttagtggatgcgctcaagctgcaggaccagctgaaggctcccgtgaagaccttgtcagagggaataaagcgaaagctgtgctttgtgctgagcatcctggggaacccgtcagtggtgcttctggatgagccgtcgaccgggatggaccccgaggggcagcagcaaatgtggcaggtgattcgggccacctttagaaacacggagaggggcgccctcctgaccacccactacatggcagaggctgaggcggtgtgtgaccgagtggccatcatggtgtcaggaaggctgagatgtattggttccatccaacacctgaaaagcaaatttggcaaagactacctgctggagatgaagctgaagaacctggcacaaatggagcccctccatgcagagatcctgaggcttttcccccaggctgctcagcaggaaaggttctcctccctgatggtctataagttgcctgttgaggatgtgcgacctttatcacaggctttcttcaaattagagatagttaaacagagtttcgacctggaggagtacagcctctcacagtctaccctggagcaggttttcctggagctctccaaggagcaggagctgggtgatcttgaagaggactttgatccctcgcactgtttacaatagcaaagacttggaaccaaccaaaatacccacaaatgatagaccggataaagaaaacgtgacacatatacaccatggaatactatgcagccatagaaaaggatgagttcatattcttcacagggacatggatgaagctggaaaccatcatcctcagcaaactaacacaggaacagaaaaccaaacaccgcatgttctcactcataagtgggaattgaacaatgagaatacatggacacagggaggggaacaccacaccctggggcctgttggggggatgggggctaggggagggatagcattaggagaaatacctgatgtagatgatgggttgatgggtgcagcaaagtaccatggcacatgtatacctgtgtaacaaacctgcacattcagcacatgtatcccagaacttaaagtataataaaaataaataaa

SEQ ID NO: 5105 - DNA, 857 bp, synthetic construct; identical to SEQ ID NO: 1374
  misc_feature 1..857: note = Synthetic polypeptide
  source 1..857: mol_type = other DNA

SEQ ID NO: 5106 - DNA, 890 bp, synthetic construct; identical to SEQ ID NO: 319
  misc_feature 1..890: note = Synthetic polypeptide
  source 1..890: mol_type = other DNA

SEQ ID NO: 5107 - DNA, 947 bp, synthetic construct; identical to SEQ ID NO: 320
  misc_feature 1..947: note = Synthetic polypeptide
  source 1..947: mol_type = other DNA

SEQ ID NO: 5108 - DNA, 475 bp, synthetic construct; identical to SEQ ID NO: 4531
  misc_feature 1..475: note = Synthetic polypeptide
  source 1..475: mol_type = other DNA

SEQ ID NO: 5109 - DNA, 2087 bp, synthetic construct
  misc_feature 1..2087: note = Synthetic polypeptide
  source 1..2087: mol_type = other DNA
atggagacttcccttagcctggagagtggccatcatgggtcttacaggagaggggaccgtcctgggctggcctggaccatggtgctgctctgggagcctgcaggagcctggcttgctctgggcctggccctggccctgggccccagcgtggccgcagctgcccctcggcaggactgcacgggcgtggagtgcccgccgctggagaactgcattgaggaggcgctggagccgggtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggcctgccactgccctgacgccggtggagagctcatctgctaccagctccccggttgccacgggaacttctcagatgccgaggagggtgaccccgagcgacactacgaagacccctacagctatgaccaggaggtggccgaggtggaagcagcaacagccctggggggtgaggtccaggcgggtgcagtccaggcaggcgcagggggccccccagctgctctgggaggtgggagtcagccactgtccaccatccaggcacccccctggccagctgtcctccccaggcccacagcggctgctgccctgggtcccccagccccagtgcaggccaaagctaggagagtgaccgaggacagtgaggaggaagaagaggaggaggaggagagagaggaaatggctgtcactgagcagctggcagcaggtggccacagggggctggatgggctgcccactacagccccagctggacccagtcttcctatccaggaggagagggcagaagctggggcaagggcagaagctggggcaaggcctgaagagaacctcatcctggatgcccaagccacgtcccgcagcactgggccggagggcgtgacgcatgcaccgagcctgggcaaggctgctctcgtcccaactcaggccgtgcctggctctcccagggacccagtcaagcccagcccccacaacatcctgtccacatcactgcctgatgcagcctggatcccacccacccgagaagtgcccaggaagccgcaagttctgccccattcccacgtggaggaggacacagaccccaactctgtccattctatccccagaagtagccctgaaggctccaccaaggacctgatcgagacttgctgcgcagccggacagcagtgggccattgacaatgacgagtgcctggagatccctgagagtggcactgaggacaacgtctgcaggacagcccagaggcactgctgtgtctcctacttgcaggagaagagctgcatggccggcgtcctgggagccaaggagggtgagacctgtggggctgaggacaacgacagctgcggcatctccctgtacaagcaatgctgtgactgctgtggcctgggcctccgcgtgcgggccgagggccagtcgtgtgagtccaatcctaacctgggctatccctgcaatcatgtcatgctctcctgctgtgagggtgaagagcctctcatagtacctgaggttcgccgacctccagagcccgcagctgcaccacggagagtttcagaggcagagatggcgggccgagaggccctgtcactgggcacagaggccgagctgccgaacagcctgccgggcgatgaccaggatgagtgccttctcctcccgggagagctgtgccagcacctttgcatcaatactgtgggttcttaccactgtgcctgctttcctggcttctcactgcaggacgatggccgcacttgccgcccagtagctgagattgatctttcccaaggtatatgcacactccaaacctcattttcctctcctgtgaaatgggg

SEQ ID NO: 5110 - DNA, 2009 bp, synthetic construct
  misc_feature 1..2009: note = Synthetic polypeptide
  source 1..2009: mol_type = other DNA
atggtgctgctctgggagcctgcaggagcctggcttgctctgggcctggccctggccctgggccccagcgtggccgcagctgcccctcggcaggactgcacgggcgtggagtgcccgccgctggagaactgcattgaggaggcgctggagccgggtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggcctgccactgccctgacgccggtggagagctcatctgctaccagctccccggttgccacgggaacttctcagatgccgaggagggtgaccccgagcgacactacgaagacccctacagctatgaccaggaggtggccgaggtggaagcagcaacagccctggggggtgaggtccaggcgggtgcagtccaggcaggcgcagggggccccccagctgctctgggaggtgggagtcagccactgtccaccatccaggcacccccctggccagctgtcctccccaggcccacagcggctgctgccctgggtcccccagccccagtgcaggccaaagctaggagagtgaccgaggacagtgaggaggaagaagaggaggaggaggagagagaggaaatggctgtcactgagcagctggcagcaggtggccacagggggctggatgggctgcccactacagccccagctggacccagtcttcctatccaggaggagagggcagaagctggggcaagggcagaagctggggcaaggcctgaagagaacctcatcctggatgcccaagccacgtcccgcagcactgggccggagggcgtgacgcatgcaccgagcctgggcaaggctgctctcgtcccaactcaggccgtgcctggctctcccagggacccagtcaagcccagcccccacaacatcctgtccacatcactgcctgatgcagcctggatcccacccacccgagaagtgcccaggaagccgcaagttctgccccattcccacgtggaggaggacacagaccccaactctgtccattctatccccagaagtagccctgaaggctccaccaaggacctgatcgagacttgctgcgcagccggacagcagtgggccattgacaatgacgagtgcctggagatccctgagagtggcactgaggacaacgtctgcaggacagcccagaggcactgctgtgtctcctacttgcaggagaagagctgcatggccggcgtcctgggagccaaggagggtgagacctgtggggctgaggacaacgacagctgcggcatctccctgtacaagcaatgctgtgactgctgtggcctgggcctccgcgtgcgggccgagggccagtcgtgtgagtccaatcctaacctgggctatccctgcaatcatgtcatgctctcctgctgtgagggtgaagagcctctcatagtacctgaggttcgccgacctccagagcccgcagctgcaccacggagagtttcagaggcagagatggcgggccgagaggccctgtcactgggcacagaggccgagctgccgaacagcctgccgggcgatgaccaggatgagtgccttctcctcccgggagagctgtgccagcacctttgcatcaatactgtgggttcttaccactgtgcctgctttcctggcttctcactgcaggacgatggccgcacttgccgcccagtagctgagattgatctttcccaaggtatatgcacactccaaacctcattttcctctcctgtgaaatgggg

SEQ ID NO: 5111 - DNA, 558 bp, synthetic construct; identical to SEQ ID NO: 2797
  misc_feature 1..558: note = Synthetic polypeptide
  source 1..558: mol_type = other DNA

SEQ ID NO: 5112 - DNA, 916 bp, synthetic construct; identical to SEQ ID NO: 1226
  misc_feature 1..916: note = Synthetic polypeptide
  source 1..916: mol_type = other DNA

SEQ ID NO: 5113 - DNA, 1284 bp, synthetic construct; identical to SEQ ID NO: 2536
  misc_feature 1..1284: note = Synthetic polypeptide
  source 1..1284: mol_type = other DNA

SEQ ID NO: 5114 - DNA, 792 bp, synthetic construct; identical to SEQ ID NO: 4298
  misc_feature 1..792: note = Synthetic polypeptide
  source 1..792: mol_type = other DNA

SEQ ID NO: 5115 - DNA, 1491 bp, synthetic construct; identical to SEQ ID NO: 1314
  misc_feature 1..1491: note = Synthetic polypeptide
  source 1..1491: mol_type = other DNA

SEQ ID NO: 5116 - DNA, 3693 bp, synthetic construct; identical to SEQ ID NO: 1315
  misc_feature 1..3693: note = Synthetic polypeptide
  source 1..3693: mol_type = other DNA

SEQ ID NO: 5117 - DNA, 570 bp, synthetic construct
  misc_feature 1..570: note = Synthetic polypeptide
  source 1..570: mol_type = other DNA
atgccaggcccggccaccgacgcggggaagatccctttctgcgacgccaaggaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcttcctcctggccgctctgggtgtgacagctggtgcccatcgcttgtggagccacaggtcctaccgggccaagctgcctctgaggatatttctggctgtcgccaactccatggctttccagttaacccttgaacagaatgggtttgaactgcgcagcttcacttaaatgcatggattttcttctgcctccaccacctctgagacagcaagatcagcccctcctcctctcagcctactcaatgcaaagaagacaaggatgaagacctttatgatgatccacttccacttaatgaatagtaaatatattttctcttcttatgattttctt

SEQ ID NO: 5118 - DNA, 203 bp, synthetic construct
  misc_feature 1..203: note = Synthetic polypeptide
  source 1..203: mol_type = other DNA
atggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttgggagtggggacctctggatcccagtgaagagcttcgactccaagaaaatgtgcatcaaccc

SEQ ID NO: 5119 - DNA, 639 bp, synthetic construct; identical to SEQ ID NO: 1196
  misc_feature 1..639: note = Synthetic polypeptide
  source 1..639: mol_type = other DNA

SEQ ID NO: 5120 - DNA, 500 bp, synthetic construct; identical to SEQ ID NO: 1197
  misc_feature 1..500: note = Synthetic polypeptide
  source 1..500: mol_type = other DNA

SEQ ID NO: 5121 - DNA, 1346 bp, synthetic construct; identical to SEQ ID NO: 1198
  misc_feature 1..1346: note = Synthetic polypeptide
  source 1..1346: mol_type = other DNA

SEQ ID NO: 5122 - DNA, 901 bp, synthetic construct; identical to SEQ ID NO: 1199
  misc_feature 1..901: note = Synthetic polypeptide
  source 1..901: mol_type = other DNA

SEQ ID NO: 5123 - DNA, 449 bp, synthetic construct
  misc_feature 1..449: note = Synthetic polypeptide
  source 1..449: mol_type = other DNA
ggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtgtggtggcgcactcctgtagtcccaggtactcaggaggctgaggtaggagaattgtttgaactccggaggcagaggttgcagtgaaccgagatcacgtactccagcctggtcaacagagcgagactccgtcttaaaaaaaaagaa

SEQ ID NO: 5124 - DNA, 1161 bp, synthetic construct
  misc_feature 1..1161: note = Synthetic polypeptide
  source 1..1161: mol_type = other DNA
atgccgccctccgggctgcggctgctgccgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtgtggtggcgcactcctgtagtcccaggtactcaggaggctgaggtaggagaattgtttgaactccggaggcagaggttgcagtgaaccgagatcacgtactccagcctggtcaacagagcgagactccgtcttaaaaaaaaagaa

SEQ ID NO: 5125 - DNA, 2849 bp, synthetic construct; identical to SEQ ID NO: 1326
  misc_feature 1..2849: note = Synthetic polypeptide
  source 1..2849: mol_type = other DNA

SEQ ID NO: 5126 - DNA, 1925 bp, synthetic construct; identical to SEQ ID NO: 1327
  misc_feature 1..1925: note = Synthetic polypeptide
  source 1..1925: mol_type = other DNA

SEQ ID NO: 5127 - DNA, 2729 bp, synthetic construct; identical to SEQ ID NO: 1328
  misc_feature 1..2729: note = Synthetic polypeptide
  source 1..2729: mol_type = other DNA

SEQ ID NO: 5128 - DNA, 2549 bp, synthetic construct; identical to SEQ ID NO: 1329
  misc_feature 1..2549: note = Synthetic polypeptide
  source 1..2549: mol_type = other DNA

SEQ ID NO: 5129 - DNA, 266 bp, synthetic construct
  misc_feature 1..266: note = Synthetic polypeptide
  source 1..266: mol_type = other DNA
atgaccgaagaagtggatttcctgggacaggactctgatgggggtagtgaggaagtggtcctaactcctgcagagctcattgaaagattggagcagccggatgtggtggcgcatgcctgtaatcccagctactcgggaggctaaggccggaggatcacctgaacctgggaggcagaggttgtggtgagccaagatcctacccaccattgcactccagcctgggcaacaagagtgaaactccgtctcaaaaaaataataaaataaaa

SEQ ID NO: 5130 - DNA, 770 bp, synthetic construct; identical to SEQ ID NO: 3389
  misc_feature 1..770: note = Synthetic polypeptide
  source 1..770: mol_type = other DNA

SEQ ID NO: 5131 - DNA, 1110 bp, synthetic construct
  misc_feature 1..1110: note = Synthetic polypeptide
  source 1..1110: mol_type = other DNA
cacttgcagagggacgatgcgggacggtaccagtgcctggcagagaatgagatgggcgtggcgaagaaagtggtgatcctcgtcctgcagagtgctccggtgttccaggtggagccccaggacatgacagtgagatctggggatgacgtggccctgcggtgccaggccactggagagcccacacccaccattgaatggctacaggcgggtcaacccttgcgggccagccggcggctccggaccctgcccgatgggagcctgtggctggagaacgtggagactggggatgcaggcacctacgactgcgtcgctcacaacctcctgggctctgccacagcccgggcgttcctggtcgtgagaggggagccccaggggagctggggcagcatgactggggtgataaatggccggaaatttggcgtggccacactcaacaccagcgtgatgcaggaggcacactccggggtcagcagcatccacagcagcatccgccatgtcccagcaaacgtggggcctctgatgcgggtgctcgtggtcaccatcgcccccatctactgggccctggccagagagagtggggaagccctgaatggccactctctgactgggggcaggttccggcaggagtcacacgtggagtttgctacaggggagctgctcacgatgacccaggtggcccggggtctggatcccgatggcctcctgctcctcgacgtggtggtcaatggcgttgtccccgagagcctggctgacgcagatcttcaagtgcaggactttgaggagcactacgtgcaaacagggcctggccagctgttcgtgggctccacacagcgcttcttccagggcggcctcccctcgttcctacgctgcaaccacagcatccagtacaacgcggcccggggcccccagccccagctggtgcagcacctgcgggcctcagctatcagctcggcctttgatccagaggccgaggccctgcgcttccagctcgctacagccctgcaggcggctcatcagctatccttagtgttggtgtattttatgtgtgacccaaggcaattcttcttcttccagcgtggcccacagaagccgaaagataggacacccctg

SEQ ID NO: 5132 - DNA, 1068 bp, synthetic construct; identical to SEQ ID NO: 1221
  misc_feature 1..1068: note = Synthetic polypeptide
  source 1..1068: mol_type = other DNA

SEQ ID NO: 5133 - DNA, 344 bp, synthetic construct
  misc_feature 1..344: note = Synthetic polypeptide
  source 1..344: mol_type = other DNA
atgtcactcctcttgctggtggtctcagcccttcacatcctcattcttatactgcttttcgtggccactttggacaagtcctggtggactctccctgggaaagagtccctgaatctctggtacgactgcacgtggaacaacgacaccaaaacatgggcctgcagtaatgtcagcgagaatggttgtggtggcttgtgcctgtggtcccagctactcaggaggcaggggtgagagaatttcttgagccctgaaggacgaggctgcagtgagccatgattataccactgcactccagcttgggcaacagagcaagacctggtttcagaaaaaaaagaaaaaggaaa

SEQ ID NO: 5134 - DNA, 473 bp, synthetic construct; identical to SEQ ID NO: 1130
  misc_feature 1..473: note = Synthetic polypeptide
  source 1..473: mol_type = other DNA

SEQ ID NO: 5135 - DNA, 840 bp, synthetic construct
  misc_feature 1..840: note = Synthetic polypeptide
  source 1..840: mol_type = other DNA
atgacctccagctacgggcacgttctggagcggcaaccggcgctgggcggccgcttggacagcccgggcaacctcgacaccctgcaggcgaaaaagaacttctccgtcagtcacctgctagacctggaggaagccggggacatggtggcggcacaggcggatgagaacgtgggcgaggctggccggagcctgctggagtcgccgggactcaccagcggcagcgacaccccgcagcaggacaatgaccagctgaactcagaagaaaaaaagaagagaaagcagcgaaggaataggacaaccttcaatagcagccagctgcaggctttggagcgtgtctttgagcggacacactatcctgatgcttttgtgcgagaagaccttgcccgccgggtgaacctcaccgaggcgagagtgcaggtgtggtttcagaaccgaagagccaagttccgcaggaatgagagagccatgctagccaataaaaacgcttccctcctcaaatcctactcaggagacgtgactgctgtggagcagcccatcgtacctcgtcctgctccgagacccaccgattatctctcctgggggacagcgtctccgtacagcgccatggctacttattctgccacatgtgccaacaatagccctgcacagggcatcaacatggccaacagcattgccaacctgagactgaaggccaaggaatatagtttacagaggaaccagccatgcttttgtaacttgccaggtggacttgaccaactacattaccatgctgtgcctcagtttacccatttgtaaaatgggattaataatacttacctacctcacaggggtgttgtgagg

SEQ ID NO: 5136 - DNA, 128 bp, synthetic construct; identical to SEQ ID NO: 144
  misc_feature 1..128: note = Synthetic polypeptide
  source 1..128: mol_type = other DNA

SEQ ID NO: 5137 - DNA, 1259 bp, synthetic construct; identical to SEQ ID NO: 3871
  misc_feature 1..1259: note = Synthetic polypeptide
  source 1..1259: mol_type = other DNA

SEQ ID NO: 5138 - DNA, 721 bp, synthetic construct; identical to SEQ ID NO: 414
  misc_feature 1..721: note = Synthetic polypeptide
  source 1..721: mol_type = other DNA

SEQ ID NO: 5139 - DNA, 610 bp, synthetic construct; identical to SEQ ID NO: 163
  misc_feature 1..610: note = Synthetic polypeptide
  source 1..610: mol_type = other DNA

SEQ ID NO: 5140 - DNA, 800 bp, synthetic construct
  misc_feature 1..800: note = Synthetic polypeptide
  source 1..800: mol_type = other DNA
atgaatgccatcgtggctctctgccacttctgcgagctccacggcccccgcactctcttctgcacggaggtgctgcacgccccacttcctcaaggggatgggaatgaggacagtcctggccagggtgagcaggcggaagaagaggaaggtggcattcagatgaacagtcggatgcgtgcgcacagccccgcagagggggccagcgtcgagtccagcagcccggggcccaaaaagtcggacatgtgcgagggctgccggtcacttgctgcagggcacccgggatatatcagccatgataaagagacctccattaaatacgtcagccaccagcaccccagccacccccagctcttcagcattgtccgccaggcctgtgtccggagcctgagctgtgaggtctgccctggccgtgaaggccccatcttcttcggagatgagcagcacggctttgtgttcagccacaccttcttcatcaaggacagcctggccaggggcttccagcgctggtacagcatcatcaccatcatgatggaccggatctacctcatcaactcctggcccttcctgctggggaaggtccggggaatcatcgatgagctccagggcaaggcgctcaagaaatacaaaattagctgggcatggtggtgcatgcctgtaatcccagctacttgggaggctgaggcaggagaaacgcttgaacccatgaggcagaggttgtagtgagccgagatcacaccattgcactccagcctgggcgacagagtgagactccatctcaaaaaaaaaaagaaaggaaaaaa

SEQ ID NO: 5141 - DNA, 641 bp, synthetic construct
  misc_feature 1..641: note = Synthetic polypeptide
  source 1..641: mol_type = other DNA
atgaacagtcggatgcgtgcgcacagccccgcagagggggccagcgtcgagtccagcagcccggggcccaaaaagtcggacatgtgcgagggctgccggtcacttgctgcagggcacccgggatatatcagccatgataaagagacctccattaaatacgtcagccaccagcaccccagccacccccagctcttcagcattgtccgccaggcctgtgtccggagcctgagctgtgaggtctgccctggccgtgaaggccccatcttcttcggagatgagcagcacggctttgtgttcagccacaccttcttcatcaaggacagcctggccaggggcttccagcgctggtacagcatcatcaccatcatgatggaccggatctacctcatcaactcctggcccttcctgctggggaaggtccggggaatcatcgatgagctccagggcaaggcgctcaagaaatacaaaattagctgggcatggtggtgcatgcctgtaatcccagctacttgggaggctgaggcaggagaaacgcttgaacccatgaggcagaggttgtagtgagccgagatcacaccattgcactccagcctgggcgacagagtgagactccatctcaaaaaaaaaaagaaaggaaaaaa

SEQ ID NO: 5142 - DNA, 118 bp, synthetic construct; identical to SEQ ID NO: 4271
  misc_feature 1..118: note = Synthetic polypeptide
  source 1..118: mol_type = other DNA

SEQ ID NO: 5143 - DNA, 603 bp, synthetic construct; identical to SEQ ID NO: 2748
  misc_feature 1..603: note = Synthetic polypeptide
  source 1..603: mol_type = other DNA

SEQ ID NO: 5144 - DNA, 1479 bp, synthetic construct
  misc_feature 1..1479: note = Synthetic polypeptide
  source 1..1479: mol_type = other DNA
atgagtgggggccgcttcgactttgatgatggaggggcgtactgcgggggctgggaggggggaaaggcccatgggcatggactgtgcacaggccccaagggccagggcgaatactctggctcctggaactttggctttgaggtggcaggtgtctacacctggcccagcggaaacacctttgagggatactggagccagggcaaacggcatgggctgggcatagagaccaaggggcgctggctctacaagggcgagtggacacatggcttcaagggacgctacggaatccggcagagctcaagcagcggtgccaagtatgagggcacctggaacaatggcctgcaagacggctatggcaccgagacctatgctgatggagggacgtaccaaggccagttcaccaacggcatgcgccatggctacggagtacgccagagcgtgccctacgggatggccgtggtggtgcgctcgccgctgcgcacgtcgctgtcgtccctgcgcagcgagcacagcaacggcacggtggccccggactctcccgcctcgccggcctccgacggccccgcgctgccctcgcccgccatcccgcgtggcggcttcgcgctcagcctcctggccaatgccgaggcggccgcgcgggcgcccaagggcggcggcctcttccagcggggcgcgctgctgggcaagctgcggcgcgcagagtcgcgcacgtccgtgggtagccagcgcagccgtgtcagcttccttaagagcgacctcagctcgggcgccagcgacgccgcgtccaccgccagcctgggagaggccgccgagggcgccgacgaggccgcacccttcgaggccgatatcgacgccaccaccaccgagacctacatgggcgagtggaagaacgacaaacgctcgggcttcggcgtgagcgaacgctccagtggcctccgctacgagggcgagtggctggacaacctgcgccacggctatggctgcaccacgctgcccgacggccaccgcgaggagggcaagtaccgccacaacgtgctggtcaaggacaccaagcgccgcatgctgcagctcaagagcaacaaggtccgccagaaagtggagcacagtgtggagggtgcccagcgcgccgctgctatcgcgcgccagaaggccgagattgccgcctccaggtgggcagtggggagcccggaaccagcttgtgcccagagaaagagttaagctgctgaccctgaaggcaagggagagccggcagcacagcggtgtatgggagcagcccactcaagcagctaaaacagggcggacggtgtgagaaaactactgatgagagaagagtgtgtaagagctgttgatgagagagctgctgaataaaactacatttcacctgcctatggcacccgcccagtgtttttcacctatctgcccatccgcccactccccttggacctcagtatgggcccgaacctgaccccaagcaggaca

SEQ ID NO: 5145 - DNA, 456 bp, synthetic construct
  misc_feature 1..456: note = Synthetic polypeptide
  source 1..456: mol_type = other DNA
atgatcttagctctctgcaacttccgcctcctgggctcaagcgattctcctgtctcaggctccggagtagctgggactacaggcatgcgccacaacaccagggaaaaaaacaaaccaaccaacaaactgagcctgaaactgataacacagatacgtacagcatcatatttaagtaaccaatcggaattattgcagtggagatgttttattggactggtgtcctcatcagaagaggaagagacatcagaagcaggtctgcacagaggagaagccatgctgggatacaatgagagggcatctgtcagcaagccaaggagagaagcctcaggagaaaccacagctatcgacaccttgattttagacttccaacctccagaaatgtgagaaatacatttatgttgttttagccacccactctgtgataccgtgttatggcagccctagaagactaatata

SEQ ID NO: 5146 - DNA, 1649 bp, synthetic construct; identical to SEQ ID NO: 2810
  misc_feature 1..1649: note = Synthetic polypeptide
  source 1..1649: mol_type = other DNA

SEQ ID NO: 5147 - DNA, 1508 bp, synthetic construct; identical to SEQ ID NO: 2811
  misc_feature 1..1508: note = Synthetic polypeptide
  source 1..1508: mol_type = other DNA

SEQ ID NO: 5148 - DNA, 782 bp, synthetic construct; identical to SEQ ID NO: 2812
  misc_feature 1..782: note = Synthetic polypeptide
  source 1..782: mol_type = other DNA

SEQ ID NO: 5149 - DNA, 1504 bp, synthetic construct; identical to SEQ ID NO: 2813
  misc_feature 1..1504: note = Synthetic polypeptide
  source 1..1504: mol_type = other DNA

SEQ ID NO: 5150 - DNA, 1007 bp, synthetic construct; identical to SEQ ID NO: 2814
  misc_feature 1..1007: note = Synthetic polypeptide
  source 1..1007: mol_type = other DNA

SEQ ID NO: 5151 - DNA, 1412 bp, synthetic construct
  misc_feature 1..1412: note = Synthetic polypeptide
  source 1..1412: mol_type = other DNA
atgctcctggctgttttgtactgcctgctgtggagtttccagacctccgctggccatttccctagagcctgtgtctcctctaagaacctgatggagaaggaatgctgtccaccgtggagcggggacaggagtccctgtggccagctttcaggcagaggttcctgtcagaatatccttctgtccaatgcaccacttgggcctcaatttcccttcacaggggtggatgaccgggagtcgtggccttccgtcttttataataggacctgccagtgctctggcaacttcatgggattcaactgtggaaactgcaagtttggcttttggggaccaaactgcacagagagacgactcttggtgagaagaaacatcttcgatttgagtgccccagagaaggacaaattttttgcctacctcactttagcaaagcataccatcagctcagactatgtcatccccatagggacctatggccaaatgaaaaatggatcaacacccatgtttaacgacatcaatatttatgacctctttgtctggatgcattattatgtgtcaatggatgcactgcttgggggatctgaaatctggagagacattgattttgcccatgaagcaccagcttttctgccttggcatagactcttcttgttgcggtgggaacaagaaatccagaagctgacaggagatgaaaacttcactattccatattgggactggcgggatgcagaaaagtgtgacatttgcacagatgagtacatgggaggtcagcaccccacaaatcctaacttactcagcccagcatcattcttctcctcttggcagattgtctgtagccgattggaggagtacaacagccatcagtctttatgcaatggaacgcccgagggacctttacggcgtaatcctggaaaccatgacaaatccagaaccccaaggctcccctcttcagctgatgtagaattttgcctgagtttgacccaatatgaatctggttccatggataaagctgccaatttcagctttagaaatacactggaaggatttgctagtccacttactgggatagcggatgcctctcaaagcagcatgcacaatgccttgcacatctatatgaatggaacaatgtcccaggtacagggatctgccaacgatcctatcttccttcttcaccatgcatttgttgacagatgtgacctgcctcaggaagaaatgtctgcctcatacacttaaatttaccctcgtatgtactcttgtctaccctgtggatcctcctcatgctgtactctgcttacttgcctgttttcttaacagtgttcaccattagttctgcattgatcatatctagtttgttcatagttttattgctaggacctaacaaaatgtcaagaaatacgatatgtgtctgataaatattt

SEQ ID NO: 5152 - DNA, 434 bp, synthetic construct; identical to SEQ ID NO: 992
  misc_feature 1..434: note = Synthetic polypeptide
  source 1..434: mol_type = other DNA

SEQ ID NO: 5153 - DNA, 860 bp, synthetic construct; identical to SEQ ID NO: 2285
  misc_feature 1..860: note = Synthetic polypeptide
  source 1..860: mol_type = other DNA

SEQ ID NO: 5154 - DNA, 1823 bp, synthetic construct; identical to SEQ ID NO: 2286
  misc_feature 1..1823: note = Synthetic polypeptide
  source 1..1823: mol_type = other DNA

SEQ ID NO: 5155 - DNA, 1796 bp, synthetic construct; identical to SEQ ID NO: 2287
  misc_feature 1..1796: note = Synthetic polypeptide
  source 1..1796: mol_type = other DNA

SEQ ID NO: 5156 - DNA, 67 bp, synthetic construct
  misc_feature 1..67: note = Synthetic polypeptide
  source 1..67: mol_type = other DNA
atgttagcaaggaacatttgaaaaggaaattggaaaaataattccatttaccatagcatttaagaga

SEQ ID NO: 5157 - DNA, 1486 bp, synthetic construct
  misc_feature 1..1486: note = Synthetic polypeptide
  source 1..1486: mol_type = other DNA
atgctcctggctgttttgtactgcctgctgtggagtttccagacctccgctggccatttccctagagcctgtgtctcctctaagaacctgatggagaaggaatgctgtccaccgtggagcggggacaggagtccctgtggccagctttcaggcagaggttcctgtcagaatatccttctgtccaatgcaccacttgggcctcaatttcccttcacaggggtggatgaccgggagtcgtggccttccgtcttttataataggacctgccagtgctctggcaacttcatgggattcaactgtggaaactgcaagtttggcttttggggaccaaactgcacagagagacgactcttggtgagaagaaacatcttcgatttgagtgccccagagaaggacaaattttttgcctacctcactttagcaaagcataccatcagctcagactatgtcatccccatagggacctatggccaaatgaaaaatggatcaacacccatgtttaacgacatcaatatttatgacctctttgtctggatgcattattatgtgtcaatggatgcactgcttgggggatctgaaatctggagagacattgattttgcccatgaagcaccagcttttctgccttggcatagactcttcttgttgcggtgggaacaagaaatccagaagctgacaggagatgaaaacttcactattccatattgggactggcgggatgcagaaaagtgtgacatttgcacagatgagtacatgggaggtcagcaccccacaaatcctaacttactcagcccagcatcattcttctcctcttggcagattgtctgtagccgattggaggagtacaacagccatcagtctttatgcaatggaacgcccgagggacctttacggcgtaatcctggaaaccatgacaaatccagaaccccaaggctcccctcttcagctgatgtagaattttgcctgagtttgacccaatatgaatctggttccatggataaagctgccaatttcagctttagaaatacactggaaggatttgctagtccacttactgggatagcggatgcctctcaaagcagcatgcacaatgccttgcacatctatatgaatggaacaatgtcccaggtacagggatctgccaacgatcctatcttccttcttcaccatgcatttgttgacagtatttttgagcagtggctccgaaggcaccgtcctcttcaagaagtttatccagaagccaatgcacccattggacataaccgggaatcctacatggttccttttataccactgtacagaaatggtgatttctttatttcatccaaagatctgggctatgactatagctatctacaagattcagtgggacagtcttctggggtgcattccctgacttcacagagatgtaggaagtcttttctccatgatgcctttctatcttcatcagaacaacattactctcgaaatgatttgtttacctgcc

SEQ ID NO: 5158 - DNA, 1398 bp, synthetic construct; identical to SEQ ID NO: 948
  misc_feature 1..1398: note = Synthetic polypeptide
  source 1..1398: mol_type = other DNA

SEQ ID NO: 5159 - DNA, 1302 bp, synthetic construct; identical to SEQ ID NO: 949
  misc_feature 1..1302: note = Synthetic polypeptide
  source 1..1302: mol_type = other DNA

SEQ ID NO: 5160 - DNA, 575 bp, synthetic construct
  misc_feature 1..575: note = Synthetic polypeptide
  source 1..575: mol_type = other DNA
atgttccagaacctgcaaggaacatttgaaaaggaaattggaaaaataattccatttaccatagcatttaagagagctgaggctgtggagccagatggctgcgttcagagctggcgctgctgtttaccatgtgaccttggacaagcttctcgcttcattcataccacagtttgttcggctattaggtggaggagctgtaagggggagaggaactttgctgaaaggcacatcctccctgcagagcttgaagaacaatctaaccatgctggcatggggcccatcctacctgcaatgccaaggaactgactcagcacaagaagacagcttcgactccctatgatttcatctctgaccaatcagcactcctggcacactggcttcccccaacccaccaagttatccttaaaaactccattccctgattgctaggggagacagatttgagtaataataaaactccggtctcccccacagctggctctgcacgaattactcttcttctattgcaattcccctgtcttgatgaatcggctctgtctaggcagcaggcaaggtgaaccctttgagcagttaca

SEQ ID NO: 5161 - DNA, 875 bp, synthetic construct
  misc_feature 1..875: note = Synthetic polypeptide
  source 1..875: mol_type = other DNA
atgccccagctttcccaagataaccaagagtgcctccagaaacatttctccaggccgtctatatggacacagtttctgcccctgttcagggctcagagatataatacagacattcaccaaatcacagaaaatgaaggagacctcagggctgttcctgatatcaagtccttcccgcctgcacagctcccagactcgcccgccgccccgaagctgttcggcctcctttctagcccgctttccagcctcgcaaggttcttctctcaccttctccggcgaccccctcccgaggctccccggaggcgcctggacttctcccccctgcttcccgccctgccggccgcccggctctcgagggggcacgaggagctgccgggccgcctctcgctcctgctcggggcggcgctggcactgcccggccgaccctcggggggtcgtccgctgaggcccccccatccggtagccaagcccagggaagaagacgccaccgctgggcagagctcgcctatgccgggtctttgcatgcaccaccacatctggctaatcaagtgaagatgaggccaaactggatgaaggcgggcctgaaatccaacgactggtgaccttataaggagggagagcttcaaagacccaggcagtcatagagggaagaagggcaagtggcaaagaagacagagattgggtttctgttgccaccgaggctgccagaagaggcaaggaagaatcctcccctagagccttcagaggcagatgcctggccctgctgacggtttggttttgaacttttagcctccagaactgtgcaagaataaatttctgttgttttaagccatcgggtttgtggtaatttgttatggcagctctaggaaactaatcca

SEQ ID NO: 5162 - DNA, 499 bp, synthetic construct; identical to SEQ ID NO: 2210
  misc_feature 1..499: note = Synthetic polypeptide
  source 1..499: mol_type = other DNA

SEQ ID NO: 5163 - DNA, 1141 bp, synthetic construct; identical to SEQ ID NO: 1825
  misc_feature 1..1141: note = Synthetic polypeptide
  source 1..1141: mol_type = other DNA

SEQ ID NO: 5164 - DNA, 1110 bp, synthetic construct
  misc_feature 1..1110: note = Synthetic polypeptide
  source 1..1110: mol_type = other DNA
atgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggctcagtgctgcggtgggaagattgctggagcccaggagttcgaggctgcggtgagccatgatcacaccactgtactccagcaacacagcgaaaccctgtctc

SEQ ID NO: 5165 - DNA, 1026 bp, synthetic construct
  misc_feature 1..1026: note = Synthetic polypeptide
  source 1..1026: mol_type = other DNA
atgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggctcagtgctgcggtgggaagattgctggagcccaggagttcgaggctgcggtgagccatgatcacaccactgtactccagcaacacagcgaaaccctgtctc

SEQ ID NO: 5166 - DNA, 822 bp, synthetic construct
  misc_feature 1..822: note = Synthetic polypeptide
  source 1..822: mol_type = other DNA
atggcagaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggctcagtgctgcggtgggaagattgctggagcccaggagttcgaggctgcggtgagccatgatcacaccactgtactccagcaacacagcgaaaccctgtctc

SEQ ID NO: 5167 - DNA, 668 bp, synthetic construct
  misc_feature 1..668: note = Synthetic polypeptide
  source 1..668: mol_type = other DNA
atggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggtgcagtggctcactcctgtaatcccagcactttgggaggctgaggcgggtggatcatctgaggtcaggagttcaagaccagcctggccaacatggtgaaatcccttctctactaaaaaaaatacaaaaattagctggatggtggtgcgcgcctgtaatcccagccactcaggaggctgaggcaggagaattgcctgaacccaggaggcagaggttgcagtgagccaagatcacaccattgcactccagcctgggtgacaaagtgagactctaccaaaaaacaaacaaaaaaccctaaaaaacaaaa

SEQ ID NO: 5168 - DNA, 707 bp, synthetic construct
  misc_feature 1..707: note = Synthetic polypeptide
  source 1..707: mol_type = other DNA
atggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctggaaggctgggatgcatgggagaccttttttctactccagactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggtgcagtggctcactcctgtaatcccagcactttgggaggctgaggcgggtggatcatctgaggtcaggagttcaagaccagcctggccaacatggtgaaatcccttctctactaaaaaaaatacaaaaattagctggatggtggtgcgcgcctgtaatcccagccactcaggaggctgaggcaggagaattgcctgaacccaggaggcagaggttgcagtgagccaagatcacaccattgcactccagcctgggtgacaaagtgagactctaccaaaaaacaaacaaaaaaccctaaaaaacaaaa

SEQ ID NO: 5169 - DNA, 509 bp, synthetic construct
  misc_feature 1..509: note = Synthetic polypeptide
  source 1..509: mol_type = other DNA
atgggagaccttttttctactccagactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggtgcagtggctcactcctgtaatcccagcactttgggaggctgaggcgggtggatcatctgaggtcaggagttcaagaccagcctggccaacatggtgaaatcccttctctactaaaaaaaatacaaaaattagctggatggtggtgcgcgcctgtaatcccagccactcaggaggctgaggcaggagaattgcctgaacccaggaggcagaggttgcagtgagccaagatcacaccattgcactccagcctgggtgacaaagtgagactctaccaaaaaacaaacaaaaaaccctaaaaaacaaaa

SEQ ID NO: 5170 - DNA, 890 bp, synthetic construct; identical to SEQ ID NO: 319
  misc_feature 1..890: note = Synthetic polypeptide
  source 1..890: mol_type = other DNA

SEQ ID NO: 5171 - DNA, 947 bp, synthetic construct; identical to SEQ ID NO: 320
  misc_feature 1..947: note = Synthetic polypeptide
  source 1..947: mol_type = other DNA

SEQ ID NO: 5172 - DNA, 1146 bp, synthetic construct; identical to SEQ ID NO: 988
  misc_feature 1..1146: note = Synthetic polypeptide
  source 1..1146: mol_type = other DNA

SEQ ID NO: 5173 - DNA, 354 bp, synthetic construct
  misc_feature 1..354: note = Synthetic polypeptide
  source 1..354: mol_type = other DNA
atgcggggtccgagcggggctctgtggctgctcctggctctgcgcaccgtgctcggtggcatggaggtgcggtggtgcgccacctcggacccagagcagcacaagtgcggcaacatgagcgaggccttccgggaagcgggcatccagccctccctcctctgcgtccggggcacctccgccgaccactgcgtccagctcatcgcggcccaggaggctgacgccatcactctggatggaggagccatctatgaggcgggaaaggagcacggcctgaagccggtggtgggcgaagtgtacgatcaagactgtataatggggatagtaacacctgcgctgtcacccagactaaatgag

SEQ ID NO: 5174 - DNA, 785 bp, synthetic construct
  misc_feature 1..785: note = Synthetic polypeptide
  source 1..785: mol_type = other DNA
atgcggcccctgctgctactggccctgctgggctggctgctgctggccgaagcgaagggcgacgccaagccggaggccccctgttgccaagagggcctcagagctggtggctctggttctcttcacctggggagagacttcaccgtcctggcaggagctcgggggagcccttccccaagtgtgagcagcatccctcgtttctggatcccaggttcagacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggtctccagtgcagaatgtcctgaatagagctcctgacttttcaaccccaaatgtgctcccctgcagttctgatctcattcaacagacacgcagccccatagacagaacccaggagtcactcctgactcctcccttgccctcctccacctacgtccaatgccagtcacctgtctactac

SEQ ID NO: 5175 - DNA, 644 bp, synthetic construct
  misc_feature 1..644: note = Synthetic polypeptide
  source 1..644: mol_type = other DNA
atgcggcccctgctgctactggccctgctgggctggctgctgctggccgaagcgaagggcgacgccaagccggaggacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggtctccagtgcagaatgtcctgaatagagctcctgacttttcaaccccaaatgtgctcccctgcagttctgatctcattcaacagacacgcagccccatagacagaacccaggagtcactcctgactcctcccttgccctcctccacctacgtccaatgccagtcacctgtctactac

SEQ ID NO: 5176 - DNA, 2466 bp, synthetic construct; identical to SEQ ID NO: 1682
  misc_feature 1..2466: note = Synthetic polypeptide
  source 1..2466: mol_type = other DNA

SEQ ID NO: 5177 - DNA, 1806 bp, synthetic construct; identical to SEQ ID NO: 1683
  misc_feature 1..1806: note = Synthetic polypeptide
  source 1..1806: mol_type = other DNA

SEQ ID NO: 5178 - DNA, 2412 bp, synthetic construct; identical to SEQ ID NO: 1684
  misc_feature 1..2412: note = Synthetic polypeptide
  source 1..2412: mol_type = other DNA

SEQ ID NO: 5179 - DNA, 2211 bp, synthetic construct; identical to SEQ ID NO: 1685
  misc_feature 1..2211: note = Synthetic polypeptide
  source 1..2211: mol_type = other DNA

SEQ ID NO: 5180 - DNA, 364 bp, synthetic construct; identical to SEQ ID NO: 1686
  misc_feature 1..364: note = Synthetic polypeptide
  source 1..364: mol_type = other DNA

SEQ ID NO: 5181 - DNA, 39 bp, synthetic construct; identical to SEQ ID NO: 2401
  misc_feature 1..39: note = Synthetic polypeptide
  source 1..39: mol_type = other DNA

SEQ ID NO: 5182 - DNA, 483 bp, synthetic construct; identical to SEQ ID NO: 2246
  misc_feature 1..483: note = Synthetic polypeptide
  source 1..483: mol_type = other DNA

SEQ ID NO: 5183 - DNA, 1356 bp, synthetic construct
  misc_feature 1..1356: note = Synthetic polypeptide
  source 1..1356: mol_type = other DNA
atgctcctggctgttttgtactgcctgctgtggagtttccagacctccgctggccatttccctagagcctgtgtctcctctaagaacctgatggagaaggaatgctgtccaccgtggagcggggacaggagtccctgtggccagctttcaggcagaggttcctgtcagaatatccttctgtccaatgcaccacttgggcctcaatttcccttcacaggggtggatgaccgggagtcgtggccttccgtcttttataataggacctgccagtgctctggcaacttcatgggattcaactgtggaaactgcaagtttggcttttggggaccaaactgcacagagagacgactcttggtgagaagaaacatcttcgatttgagtgccccagagaaggacaaattttttgcctacctcactttagcaaagcataccatcagctcagactatgtcatccccatagggacctatggccaaatgaaaaatggatcaacacccatgtttaacgacatcaatatttatgacctctttgtctggatgcattattatgtgtcaatggatgcactgcttgggggatctgaaatctggagagacattgattttgcccatgaagcaccagcttttctgccttggcatagactcttcttgttgcggtgggaacaagaaatccagaagctgacaggagatgaaaacttcactattccatattgggactggcgggatgcagaaaagtgtgacatttgcacagatgagtacatgggaggtcagcaccccacaaatcctaacttactcagcccagcatcattcttctcctcttggcagattgtctgtagccgattggaggagtacaacagccatcagtctttatgcaatggaacgcccgagggacctttacggcgtaatcctggaaaccatgacaaatccagaaccccaaggctcccctcttcagctgatgtagaattttgcctgagtttgacccaatatgaatctggttccatggataaagctgccaatttcagctttagaaatacactggaaggatttgctagtccacttactgggatagcggatgcctctcaaagcagcatgcacaatgccttgcacatctatatgaatggaacaatgtcccagatgtgacctgcctcaggaagaaatgtctgcctcatacacttaaatttaccctcgtatgtactcttgtctaccctgtggatcctcctcatgctgtactctgcttacttgcctgttttcttaacagtgttcaccattagttctgcattgatcatatctagtttgttcatagttttattgctaggacctaacaaaatgtcaagaaatacgatatgtgtctgataaatattt

SEQ ID NO: 5184 - DNA, 139 bp, synthetic construct
  misc_feature 1..139: note = Synthetic polypeptide
  source 1..139: mol_type = other DNA
ccaacttctggggcgccctgagccccgatgagtactacgcccgctccgaggactacgtggagctggtgcagcggaagcgagtcctgggtgacagagcaagactccgtctcaaaaaccaaaaacaagaaacaaaaaagaa

SEQ ID NO: 5185 - DNA, 1415 bp, synthetic construct
  misc_feature 1..1415: note = Synthetic polypeptide
  source 1..1415: mol_type = other DNA
atgacctcctcggggcctggaccccggttcctgctgctgctgccgctgctgctgccccctgcggcctcagcctccgaccggccccggggccgagacccggtcaacccagagaagctgctggtgatcactgtggccacagctgaaaccgaggggtacctgcgtttcctgcgctctgcggagttcttcaactacactgtgcggaccctgggcctgggagaggagtggcgagggggtgatgtggctcgaacagttggtggaggacagaaggtccggtggttaaagaaggaaatggagaaatacgctgaccgggaggatatgatcatcatgtttgtggatagctacgacgtgattctggccggcagccccacagagctgctgaagaagttcgtccagagtggcagccgcctgctcttctctgcagagagcttctgctggcccgagtgggggctggcggagcagtaccctgaggtgggcacggggaagcgcttcctcaattctggtggattcatcggttttgccaccaccatccaccaaatcgtgcgccagtggaagtacaaggatgatgacgacgaccagctgttctacacacggctctacctggacccaggactgagggagaaactcagccttaatctggatcataagtctcggatctttcagaacctcaacggggctttagatgaagtggttttaaagtttgatcggaaccgtgtgcgtatccggaacgtggcctacgacacgctccccattgtggtccatggaaacggtcccactaagctgcagctcaactacctgggaaactacgtccccaatggctggactcctgagggaggctgtggcttctgcaaccaggaccggaggacactcccgggggggcagcctcccccccgggtgtttctggccgtgtttgtggaacagcctactccgtttctgccccgcttcctgcagcggctgctactcctggactatccccccgacagggtcacccttttcctgcacaacaacgaggtcttccatgaaccccacatcgctgactcctggccgcagctccaggaccacttctcagctgtgaagctcgtggggccggaggaggctctgagcccaggcgaggccagggacatggccatggacctgtgtcggcaggaccccgagtgtgagttctacttcagcctggacgccgacgctgtcctcaccaacctgcagaccctgcgtatcctcattgaggagaacaggaaggtgatcgcccccatgctgtcccgccacggcaagctgtggtccaacttctggggcgccctgagccccgatgagtactacgcccgctccgaggactacgtggagctggtgcagcggaagcgagtcctgggtgacagagcaagactccgtctcaaaaaccaaaaacaagaaacaaaaaagaa

SEQ ID NO: 5186 - DNA, 253 bp, synthetic construct
  misc_feature 1..253: note = Synthetic polypeptide
  source 1..253: mol_type = other DNA
acttcagcctggacgccgacgctgtcctcaccaacctgcagaccctgcgtatcctcattgaggagaacaggaaggtgatcgcccccatgctgtcccgccacggcaagctgtggtccaacttctggggcgccctgagccccgatgagtactacgcccgctccgaggactacgtggagctggtgcagcggaagcgagtcctgggtgacagagcaagactccgtctcaaaaaccaaaaacaagaaacaaaaaagaa

SEQ ID NO: 5187 - DNA, 787 bp, synthetic construct
  misc_feature 1..787: note = Synthetic polypeptide
  source 1..787: mol_type = other DNA
gattcatcggttttgccaccaccatccaccaaatcgtgcgccagtggaagtacaaggatgatgacgacgaccagctgttctacacacggctctacctggacccaggactgagggagaaactcagccttaatctggatcataagtctcggatctttcagaacctcaacggggctttagatgaagtggttttaaagtttgatcggaaccgtgtgcgtatccggaacgtggcctacgacacgctccccattgtggtccatggaaacggtcccactaagctgcagctcaactacctgggaaactacgtccccaatggctggactcctgagggaggctgtggcttctgcaaccaggaccggaggacactcccgggggggcaggaggtcttccatgaaccccacatcgctgactcctggccgcagctccaggaccacttctcagctgtgaagctcgtggggccggaggaggctctgagcccaggcgaggccagggacatggccatggacctgtgtcggcaggaccccgagtgtgagttctacttcagcctggacgccgacgctgtcctcaccaacctgcagaccctgcgtatcctcattgaggagaacaggaaggtgatcgcccccatgctgtcccgccacggcaagctgtggtccaacttctggggcgccctgagccccgatgagtactacgcccgctccgaggactacgtggagctggtgcagcggaagcgagtcctgggtgacagagcaagactccgtctcaaaaaccaaaaacaagaaacaaaaaagaa

SEQ ID NO: 5188 - DNA, 1052 bp, synthetic construct; identical to SEQ ID NO: 247
  misc_feature 1..1052: note = Synthetic polypeptide
  source 1..1052: mol_type = other DNA

SEQ ID NO: 5189 - DNA, 327 bp, synthetic construct; identical to SEQ ID NO: 246
  misc_feature 1..327: note = Synthetic polypeptide
  source 1..327: mol_type = other DNA

SEQ ID NO: 5190 - DNA, 767 bp, synthetic construct; identical to SEQ ID NO: 937
  misc_feature 1..767: note = Synthetic polypeptide
  source 1..767: mol_type = other DNA

SEQ ID NO: 5191 - DNA, 677 bp, synthetic construct; identical to SEQ ID NO: 938
  misc_feature 1..677: note = Synthetic polypeptide
  source 1..677: mol_type = other DNA

SEQ ID NO: 5192 - DNA, 454 bp, synthetic construct; identical to SEQ ID NO: 2297
  misc_feature 1..454: note = Synthetic polypeptide
  source 1..454: mol_type = other DNA

SEQ ID NO: 5193 - DNA, 980 bp, synthetic construct; identical to SEQ ID NO: 139
  misc_feature 1..980: note = Synthetic polypeptide
  source 1..980: mol_type = other DNA

SEQ ID NO: 5194 - DNA, 1256 bp, synthetic construct; identical to SEQ ID NO: 140
  misc_feature 1..1256: note = Synthetic polypeptide
  source 1..1256: mol_type = other DNA

SEQ ID NO: 5195 - DNA, 1277 bp, synthetic construct; identical to SEQ ID NO: 142
  misc_feature 1..1277: note = Synthetic polypeptide
  source 1..1277: mol_type = other DNA

SEQ ID NO: 5196 - DNA, 534 bp, synthetic construct; identical to SEQ ID NO: 2415
  misc_feature 1..534: note = Synthetic polypeptide
  source 1..534: mol_type = other DNA

SEQ ID NO: 5197 - DNA, 542 bp, synthetic construct; identical to SEQ ID NO: 2416
  misc_feature 1..542: note = Synthetic polypeptide
  source 1..542: mol_type = other DNA

SEQ ID NO: 5198 - DNA, 1403 bp, synthetic construct; identical to SEQ ID NO: 2417
  misc_feature 1..1403: note = Synthetic polypeptide
  source 1..1403: mol_type = other DNA

SEQ ID NO: 5199 - DNA, 491 bp, synthetic construct; identical to SEQ ID NO: 2418
  misc_feature 1..491: note = Synthetic polypeptide
  source 1..491: mol_type = other DNA

SEQ ID NO: 5200 - DNA, 578 bp, synthetic construct; identical to SEQ ID NO: 2419
  misc_feature 1..578: note = Synthetic polypeptide
  source 1..578: mol_type = other DNA

SEQ ID NO: 5201 - DNA, 1280 bp, synthetic construct; identical to SEQ ID NO: 2420
  misc_feature 1..1280: note = Synthetic polypeptide
  source 1..1280: mol_type = other DNA

SEQ ID NO: 5202 - DNA, 1370 bp, synthetic construct; identical to SEQ ID NO: 2421
  misc_feature 1..1370: note = Synthetic polypeptide
  source 1..1370: mol_type = other DNA

SEQ ID NO: 5203 - DNA, 692 bp, synthetic construct; identical to SEQ ID NO: 2422
  misc_feature 1..692: note = Synthetic polypeptide
  source 1..692: mol_type = other DNA

SEQ ID NO: 5204 - DNA, 431 bp, synthetic construct; identical to SEQ ID NO: 2423
  misc_feature 1..431: note = Synthetic polypeptide
  source 1..431: mol_type = other DNA

SEQ ID NO: 5205 - DNA, 344 bp, synthetic construct; identical to SEQ ID NO: 2424
  misc_feature 1..344: note = Synthetic polypeptide
  source 1..344: mol_type = other DNA

SEQ ID NO: 5206 - DNA, 1553 bp, synthetic construct; identical to SEQ ID NO: 2425
  misc_feature 1..1553: note = Synthetic polypeptide
  source 1..1553: mol_type = other DNA

SEQ ID NO: 5207 - DNA, 1493 bp, synthetic construct; identical to SEQ ID NO: 2426
  misc_feature 1..1493: note = Synthetic polypeptide
  source 1..1493: mol_type = other DNA

SEQ ID NO: 5208 - DNA, 638 bp, synthetic construct; identical to SEQ ID NO: 2427
  misc_feature 1..638: note = Synthetic polypeptide
  source 1..638: mol_type = other DNA

SEQ ID NO: 5209 - DNA, 1439 bp, synthetic construct; identical to SEQ ID NO: 2428
  misc_feature 1..1439: note = Synthetic polypeptide
  source 1..1439: mol_type = other DNA

SEQ ID NO: 5210 - DNA, 1352 bp, synthetic construct; identical to SEQ ID NO: 2429
  misc_feature 1..1352: note = Synthetic polypeptide
  source 1..1352: mol_type = other DNA

SEQ ID NO: 5211 - DNA, 602 bp, synthetic construct; identical to SEQ ID NO: 2430
  misc_feature 1..602: note = Synthetic polypeptide
  source 1..602: mol_type = other DNA

SEQ ID NO: 5212 - DNA, 1050 bp, synthetic construct
  misc_feature 1..1050: note = Synthetic polypeptide
  source 1..1050: mol_type = other DNA
atgctcctggctgttttgtactgcctgctgtggagtttccagacctccgctggccatttccctagagcctgtgtctcctctaagaacctgatggagaaggaatgctgtccaccgtggagcggggacaggagtccctgtggccagctttcaggcagaggttcctgtcagaatatccttctgtccaatgcaccacttgggcctcaatttcccttcacaggggtggatgaccgggagtcgtggccttccgtcttttataataggacctgccagtgctctggcaacttcatgggattcaactgtggaaactgcaagtttggcttttggggaccaaactgcacagagagacgactcttggtgagaagaaacatcttcgatttgagtgccccagagaaggacaaattttttgcctacctcactttagcaaagcataccatcagctcagactatgtcatccccatagggacctatggccaaatgaaaaatggatcaacacccatgtttaacgacatcaatatttatgacctctttgtctggatgcattattatgtgtcaatggatgcactgcttgggggatctgaaatctggagagacattgattttgcccatgaagcaccagcttttctgccttggcatagactcttcttgttgcggtgggaacaagaaatccagaagctgacaggagatgaaaacttcactattccatattgggactggcgggatgcagaaaagtgtgacatttgcacagatgagtacatgggaggtcagcaccccacaaatcctaacttactcagcccagcatcattcttctcctcttggcagattgtctgtagccgattggaggagtacaacagccatcagtctttatgcaatggaacgcccgagggacctttacggcgtaatcctggaaaccatgacaaatccagaaccccaaggctcccctcttcagctgatgtagaattttgcctgagtttgacccaatatgaatctggttccatggataaagctgccaatttcagctttagaaatacactggaagagttactacgaaga

SEQ ID NO: 5213 - DNA, 1030 bp, synthetic construct; identical to SEQ ID NO: 2232
  misc_feature 1..1030: note = Synthetic polypeptide
  source 1..1030: mol_type = other DNA

SEQ ID NO: 5214 - DNA, 1204 bp, synthetic construct; identical to SEQ ID NO: 2233
  misc_feature 1..1204: note = Synthetic polypeptide
  source 1..1204: mol_type = other DNA

SEQ ID NO: 5215 - DNA, 1692 bp, synthetic construct
  misc_feature 1..1692: note = Synthetic polypeptide
  source 1..1692: mol_type = other DNA
atgggcccgggacccccagcggccggagcggcgccgtccccgcggccgctgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcccgcgcaaggcctggcacctggtcggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgccccccgaggcggagaacaccgaacacccagtgaaggtgaggggatcagcacggcgccgccaccgtgctggaacgagactcagccacaaggaggtgcgaagctctgacccaggccacagtgcggatgcaccttgaggatgtcacgctcagtgagagacaccagacacagaagggtacgctgtgatcccacttctatgaaatgtccaggacagaccaatccacagaatcagggagaggattcgtgggtgccgggactggggagggggacctgggggtgactaggtgacataatggggacagggctgccttctgggtgatgagaatgttctggaatcagatgggatggctgcacggcgtggtgaaggtactgaacgccacctcactgtaagacggtagattttgtatt

SEQ ID NO: 5216 - DNA, 1665 bp, synthetic construct
  misc_feature 1..1665: note = Synthetic polypeptide
  source 1..1665: mol_type = other DNA
atgggcccgggacccccagcggccggagcggcgccgtccccgcggccgctgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgccccccgaggcggagaacaccgaacacccagtgaaggtgaggggatcagcacggcgccgccaccgtgctggaacgagactcagccacaaggaggtgcgaagctctgacccaggccacagtgcggatgcaccttgaggatgtcacgctcagtgagagacaccagacacagaagggtacgctgtgatcccacttctatgaaatgtccaggacagaccaatccacagaatcagggagaggattcgtgggtgccgggactggggagggggacctgggggtgactaggtgacataatggggacagggctgccttctgggtgatgagaatgttctggaatcagatgggatggctgcacggcgtggtgaaggtactgaacgccacctcactgtaagacggtagattttgtatt

SEQ ID NO: 5217 - DNA, 729 bp, synthetic construct
  misc_feature 1..729: note = Synthetic polypeptide
  source 1..729: mol_type = other DNA
ctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgccccccgaggcggagaacaccgaacacccagtgaaggtgaggggatcagcacggcgccgccaccgtgctggaacgagactcagccacaaggaggtgcgaagctctgacccaggccacagtgcggatgcaccttgaggatgtcacgctcagtgagagacaccagacacagaagggtacgctgtgatcccacttctatgaaatgtccaggacagaccaatccacagaatcagggagaggattcgtgggtgccgggactggggagggggacctgggggtgactaggtgacataatggggacagggctgccttctgggtgatgagaatgttctggaatcagatgggatggctgcacggcgtggtgaaggtactgaacgccacctcactgtaagacggtagattttgtatt

SEQ ID NO: 5218 - DNA, 1074 bp, synthetic construct
  misc_feature 1..1074: note = Synthetic polypeptide
  source 1..1074: mol_type = other DNA
ctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacaacagcggagcgttcgtgtacggctccatgagcttcttggataaggtggccaatgggctggcagtcatggccatccagagcctgcacccttgccccccgaggcggagaacaccgaacacccagtgaaggtgaggggatcagcacggcgccgccaccgtgctggaacgagactcagccacaaggaggtgcgaagctctgacccaggccacagtgcggatgcaccttgaggatgtcacgctcagtgagagacaccagacacagaagggtacgctgtgatcccacttctatgaaatgtccaggacagaccaatccacagaatcagggagaggattcgtgggtgccgggactggggagggggacctgggggtgactaggtgacataatggggacagggctgccttctgggtgatgagaatgttctggaatcagatgggatggctgcacggcgtggtgaaggtactgaacgccacctcactgtaagacggtagattttgtatt

SEQ ID NO: 5219 - DNA, 276 bp, synthetic construct; identical to SEQ ID NO: 923
  misc_feature 1..276: note = Synthetic polypeptide
  source 1..276: mol_type = other DNA

SEQ ID NO: 5220 - DNA, 504 bp, synthetic construct; identical to SEQ ID NO: 1893
  misc_feature 1..504: note = Synthetic polypeptide
  source 1..504: mol_type = other DNA

SEQ ID NO: 5221 - DNA, 801 bp, synthetic construct; identical to SEQ ID NO: 1894
  misc_feature 1..801: note = Synthetic polypeptide
  source 1..801: mol_type = other DNA

SEQ ID NO: 5222 - DNA, 438 bp, synthetic construct; identical to SEQ ID NO: 1895
  misc_feature 1..438: note = Synthetic polypeptide
  source 1..438: mol_type = other DNA

SEQ ID NO: 5223 - DNA, 145 bp, synthetic construct; identical to SEQ ID NO: 1896
  misc_feature 1..145: note = Synthetic polypeptide
  source 1..145: mol_type = other DNA

SEQ ID NO: 5224 - DNA, 2497 bp, synthetic construct
  misc_feature 1..2497: note = Synthetic polypeptide
  source 1..2497: mol_type = other DNA
atgcatctggagggcagagacggcaggcggtaccccggcgcgccggcggtggagctcctgcagacgtccgtgcccagcggactcgctgaacttgtggccggcaagcgcaggcttcctcggggagccggtggagctgacccctcgcactcctgccccaggggggctgccgggcagagctcttgggctcctgcaggccaggagtttgcttcattcctcacaaaagggaggtctcactcttctttgccccagatgtccagctccaggtctaaagattcctgctttacagaaaacactcctttgctgaggaattccttacaggagaaagggtcacggtgcatacctgtttaccatccagagttcatcactgctgaagagtcttgggaagacagctctgctgactgggagcgaagatacctgctaagcagggaggtgtctggtctgtctgcatctgcctcctccgagaagggagaccttctggacagcccgcacatccgactccgtctttccaagctgaggcgctgtgtgcagtggctgaaagtcatgggcctgtttgcctttgtggtgctgtgttctattttgttcagcctatatccggatcaaggaaagctctggcagctgttggccttatcaccgctggagaactactccgtgaaccttagcagccacgtggactccacgctgctgcaggtggacctggcaggggccctagtggccagtgggccgagtcgtcctgggagggaagagcacatcgtggtggagctgacccaggctgacgctttgggctccaggtggcggcggccacagcaggtcactcacaactggacggtgtatttaaatccgaggagaagcgagcactcagtgatgagcaggacctttgaggtactgaccagagagacggtgtccatcagcatccgggcctccctgcagcagacccaggctgtccctcttttgatggctcatcagtacctccgcggaagtgtagaaacccaggtgaccatcgcgacggccatcctcgcgggcgtctacgcgctgatcatatttgagagacccagcctgacccatgtggtggagtggattgattttgagacgctggccctgctgtttggcatgatgatcttagtagccatattttcagaaacgggatttttcgattattgtgctgtaaaggcataccggctctcccggggacgggtgtgggccatgatcatcatgctctgtctcatcgcggccgtcctctctgccttcttggacaacgtcaccaccatgctcctcttcacgcctgtgaccataaggttgtgtgaggtgctcaaccttgatccaagacaagtcctgattgcagaagtgatcttcacaaacattggaggagctgccactgccatcggggaccctccaaatgtcattattgtttccaaccaagagctgaggaagatgggcctggactttgccggattcactgcacacatgttcattgggatttgccttgttctcctggtctgctttccgctcctcagactcctttactggaacagaaagctttataacaaggaacccagtgagattgttgaactgaagcacgagattcacgtctggcgcctgactgctcagcgcatcagcccggccagccgcgaggagacagctgtgcgccgcctgctgctggggaaggtgctggcactggagcacctgctcgcccggaggctgcacaccttccacagacagatctcacaggaggacaaaaattgggagaccaatatccaagaactccaaaaaaagcataggatatctgacgggattctgctcgccaaatgcctgacagtgttgggatttgttatcttcatgtttttcctcaattcgtttgtccctggcattcatcttgatcttggatggattgctattctgggtgccatctggttgctaattttagctgatattcatgattttgagataattctacacagagtggaatgggcaacccttctgttttttgcagcgctctttgttctgatggaggcattggcacatctccacttaatagaatatgttggagaacaaactgctttgctaataaagatggtcccagaggagcagcgcctcatagccgccattgtcctggtggtgtgggtctcagccctggcgtcgtccctgattgacaacatcccgttcactgctaccatgattcccgtgctcctgaacctgagccacgaccctgaggttggcctgcccgcaccgccgctcatgtatgccctggccttcggtgcttgcctgggaggtaacgggacactgattggcgcgtcggcaaacgtcgtgtgtgcagggattgcagaacagcatggatatgggttctccttcatggaatttttcaggaagagagagagagagaccagggatgtactcgcacagagaaaagccctatgaggacgtggcaagaaggactgcaaggcaaggaaggaagacctaggagaaaccaaccctgaagacatcttcatcctggacttccagc

SEQ ID NO: 5225 - DNA, 2569 bp, synthetic construct
  misc_feature 1..2569: note = Synthetic polypeptide
  source 1..2569: mol_type = other DNA
atgcatctggagggcagagacggcaggcggtaccccggcgcgccggcggtggagctcctgcagacgtccgtgcccagcggactcgctgaacttgtggccggcaagcgcaggcttcctcggggagccggtggagctgacccctcgcactcctgccccaggggggctgccgggcagagctcttgggctcctgcaggccaggagtttgcttcattcctcacaaaagggaggtctcactcttctttgccccagatgtccagctccaggtctaaagattcctgctttacagaaaacactcctttgctgaggaattccttacaggagaaagggtcacggtgcatacctgtttaccatccagagttcatcactgctgaagagtcttgggaagacagctctgctgactgggagcgaagatacctgctaagcagggaggtgtctggtctgtctgcatctgcctcctccgagaagggagaccttctggacagcccgcacatccgactccgtctttccaagctgaggcgctgtgtgcagtggctgaaagtcatgggcctgtttgcctttgtggtgctgtgttctattttgttcagcctatatccggatcaaggaaagctctggcagctgttggccttatcaccgctggagaactactccgtgaaccttagcagccacgtggactccacgctgctgcaggtggacctggcaggggccctagtggccagtgggccgagtcgtcctgggagggaagagcacatcgtggtggagctgacccaggctgacgctttgggctccaggtggcggcggccacagcaggtcactcacaactggacggtgtatttaaatccgaggagaagcgagcactcagtgatgagcaggacctttgaggtactgaccagagagacggtgtccatcagcatccgggcctccctgcagcagacccaggctgtccctcttttgatggctcatcagtacctccgcggaagtgtagaaacccaggtgaccatcgcgacggccatcctcgcgggcgtctacgcgctgatcatatttgagatcgtgcacagaactctggcggccatgctgggttcccttgcagcactggcagcactggctgtgattggcgatagacccagcctgacccatgtggtggagtggattgattttgagacgctggccctgctgtttggcatgatgatcttagtagccatattttcagaaacgggatttttcgattattgtgctgtaaaggcataccggctctcccggggacgggtgtgggccatgatcatcatgctctgtctcatcgcggccgtcctctctgccttcttggacaacgtcaccaccatgctcctcttcacgcctgtgaccataaggttgtgtgaggtgctcaaccttgatccaagacaagtcctgattgcagaagtgatcttcacaaacattggaggagctgccactgccatcggggaccctccaaatgtcattattgtttccaaccaagagctgaggaagatgggcctggactttgccggattcactgcacacatgttcattgggatttgccttgttctcctggtctgctttccgctcctcagactcctttactggaacagaaagctttataacaaggaacccagtgagattgttgaactgaagcacgagattcacgtctggcgcctgactgctcagcgcatcagcccggccagccgcgaggagacagctgtgcgccgcctgctgctggggaaggtgctggcactggagcacctgctcgcccggaggctgcacaccttccacagacagatctcacaggaggacaaaaattgggagaccaatatccaagaactccaaaaaaagcataggatatctgacgggattctgctcgccaaatgcctgacagtgttgggatttgttatcttcatgtttttcctcaattcgtttgtccctggcattcatcttgatcttggatggattgctattctgggtgccatctggttgctaattttagctgatattcatgattttgagataattctacacagagtggaatgggcaacccttctgttttttgcagcgctctttgttctgatggaggcattggcacatctccacttaatagaatatgttggagaacaaactgctttgctaataaagatggtcccagaggagcagcgcctcatagccgccattgtcctggtggtgtgggtctcagccctggcgtcgtccctgattgacaacatcccgttcactgctaccatgattcccgtgctcctgaacctgagccacgaccctgaggttggcctgcccgcaccgccgctcatgtatgccctggccttcggtgcttgcctgggaggtaacgggacactgattggcgcgtcggcaaacgtcgtgtgtgcagggattgcagaacagcatggatatgggttctccttcatggaatttttcaggaagagagagagagagaccagggatgtactcgcacagagaaaagccctatgaggacgtggcaagaaggactgcaaggcaaggaaggaagacctaggagaaaccaaccctgaagacatcttcatcctggacttccagc

SEQ ID NO: 5226 - DNA, 1736 bp, synthetic construct; identical to SEQ ID NO: 156
  misc_feature 1..1736: note = Synthetic polypeptide
  source 1..1736: mol_type = other DNA

SEQ ID NO: 5227 - DNA, 1724 bp, synthetic construct; identical to SEQ ID NO: 157
  misc_feature 1..1724: note = Synthetic polypeptide
  source 1..1724: mol_type = other DNA

SEQ ID NO: 5228 - DNA, 1608 bp, synthetic construct
  misc_feature 1..1608: note = Synthetic polypeptide
  source 1..1608: mol_type = other DNA
atgagccccctttggtgggggtttctgctcagttgcttgggctgcaaaatcctgccaggagcccagggtcagttcccccgagtctgcatgacggtggacagcctagtgaacaaggagtgctgcccacgcctgggtgcagagtcggccaatgtctgtggctctcagcaaggccgggggcagtgcacagaggtgcgagccgacacaaggccctggagtggtccctacatcctacgaaaccaggatgaccgtgagctgtggccaagaaaattcttccaccggacctgcaagtgcacaggaaactttgccggctataattgtggagactgcaagtttggctggaccggtcccaactgcgagcggaagaaaccaccagtgattcggcagaacatccattccttgagtcctcaggaaagagagcagttcttgggcgccttagatctcgcgaagaagagagtacaccccgactacgtgatcaccacacaacactggctgggcctgcttgggcccaatggaacccagccgcagtttgccaactgcagtgtttatgatttttttgtgtggctccattattattctgttagagatacattattaggaccaggacgcccctacagggccatagatttctcacatcaaggacctgcatttgttacctggcaccggtaccatttgttgtgtctggaaagagatctccagcgactcattggcaatgagtcttttgctttgccctactggaactttgccactgggaggaacgagtgtgatgtgtgtacagaccagctgtttggggcagcgagaccagacgatccgactctgattagtcggaactcaagattctccagctgggaaactgtctgtgatagcttggatgactacaaccacctggtcaccttgtgcaatggaacctatgaaggtttgctgagaagaaatcaaatgggaagaaacagcatgaaattgccaaccttaaaagacatacgagattgcctgtctctccagaagtttgacaatcctcccttcttccagaactctaccttcagtttcaggaatgctttggaagggtttgataaagcagatgggactctggattctcaagtgatgagccttcataatttggttcattccttcctgaacgggacaaacgctttgccacattcagccgccaatgatcccatttttgtggttcttcattcctttactgatgccatctttgatgagtggatgaaaagatttaatcctcctgcagatgcctggcctcaggagctggcccctattggtcacaatcggatgtacaacatggttcctttcttccctccagtgactaatgaagaactctttttaacctcagaccaacttggctacagctatgccatcgatctgccagataggactgtctccttgcaggaaaacaagctcagggctcccagattctgcattatggtgagttgtataattatttcattatatattataatgtaataataatagaaagaaagtgcacaataaatgtaatgcacttgaatcatcctgaaaccattacctctctaatcctagttcatggaaagattgtcttccatgaaactggtccctggtgtcaaaaaggttgaggac

SEQ ID NO: 5229 - DNA, 1707 bp, synthetic construct
  misc_feature 1..1707: note = Synthetic polypeptide
  source 1..1707: mol_type = other DNA
atgagccccctttggtgggggtttctgctcagttgcttgggctgcaaaatcctgccaggagcccagggtcagttcccccgagtctgcatgacggtggacagcctagtgaacaaggagtgctgcccacgcctgggtgcagagtcggccaatgtctgtggctctcagcaaggccgggggcagtgcacagaggtgcgagccgacacaaggccctggagtggtccctacatcctacgaaaccaggatgaccgtgagctgtggccaagaaaattcttccaccggacctgcaagtgcacaggaaactttgccggctataattgtggagactgcaagtttggctggaccggtcccaactgcgagcggaagaaaccaccagtgattcggcagaacatccattccttgagtcctcaggaaagagagcagttcttgggcgccttagatctcgcgaagaagagagtacaccccgactacgtgatcaccacacaacactggctgggcctgcttgggcccaatggaacccagccgcagtttgccaactgcagtgtttatgatttttttgtgtggctccattattattctgttagagatacattattaggaccaggacgcccctacagggccatagatttctcacatcaaggacctgcatttgttacctggcaccggtaccatttgttgtgtctggaaagagatctccagcgactcattggcaatgagtcttttgctttgccctactggaactttgccactgggaggaacgagtgtgatgtgtgtacagaccagctgtttggggcagcgagaccagacgatccgactctgattagtcggaactcaagattctccagctgggaaactgtctgtgatagcttggatgactacaaccacctggtcaccttgtgcaatggaacctatgaaggtttgctgagaagaaatcaaatgggaagaaacagcatgaaattgccaaccttaaaagacatacgagattgcctgtctctccagaagtttgacaatcctcccttcttccagaactctaccttcagtttcaggaatgctttggaagggtttgataaagcagatgggactctggattctcaagtgatgagccttcataatttggttcattccttcctgaacgggacaaacgctttgccacattcagccgccaatgatcccatttttgtggtgatttctaatcgtttgctttacaatgctacaacaaacatccttgaacatgtaagaaaagagaaagcgaccaaggaactcccttccctgcatgtgctggttcttcattcctttactgatgccatctttgatgagtggatgaaaagatttaatcctcctgcagatgcctggcctcaggagctggcccctattggtcacaatcggatgtacaacatggttcctttcttccctccagtgactaatgaagaactctttttaacctcagaccaacttggctacagctatgccatcgatctgccagataggactgtctccttgcaggaaaacaagctcagggctcccagattctgcattatggtgagttgtataattatttcattatatattataatgtaataataatagaaagaaagtgcacaataaatgtaatgcacttgaatcatcctgaaaccattacctctctaatcctagttcatggaaagattgtcttccatgaaactggtccctggtgtcaaaaaggttgaggac

SEQ ID NO: 5230 - DNA, 2151 bp, synthetic construct; identical to SEQ ID NO: 127
  misc_feature 1..2151: note = Synthetic polypeptide
  source 1..2151: mol_type = other DNA

SEQ ID NO: 5231 - DNA, 1833 bp, synthetic construct; identical to SEQ ID NO: 126
  misc_feature 1..1833: note = Synthetic polypeptide
  source 1..1833: mol_type = other DNA

SEQ ID NO: 5232 - DNA, 3332 bp, synthetic construct
  misc_feature 1..3332: note = Synthetic polypeptide
  source 1..3332: mol_type = other DNA
atggagaacgttgataattctctggatggcagtgatgtgtcagaaccagcaaaaccagaagccggacttgaagtggctcagtcgatcctgagtaagttctctatgaaatccctatttgggtttacgagtaaattagaatctgtgaatccagaagaggaagatgctgtgctgaaagcattccatagtttagacgtgaatcccacatctcagcaggatgattccagcaatggcttggatccacaggaagcagggtctcgggtttcacctgacctcggaaatgatgagaaaattgcaagcgtggagacagaatcagagggaagtcagagaaaagaagcagggacatctctccttgctcaagagctgcttccactgtctactttgaaagggacaaaagacgatgtcatttgtgttcgtgggaccctggtgcacaccaccagtgattctgactctgatgatggtggccaggagccagaggagggaagcagcaccaatggcccaaagtcccctagtggtgttttatctgagccatctcaggagtccaaagaaaacccaggaggtttcagggaaaatactgtcactggggaaatgaatggtgcagagctctgtgcagaagatcctcaaaggattccacctgagatgagcagcaaactggaagctggcaacggtggtcttcagacagagcgtcgccccagccaggaccaggtgggagaagaagggtcccaagacctacctgcagtaacaaaccagaattcgagtgttggtatcactgagagtgcctcttctaaaaaagaagtctctggagagaagtcattccaacttccagcttttttcagtgggcttcgtgtgctgaagaagggggctaccgctgagggaggagagaccatcacggaaattaaaccaaaggatggggacttagctttgctcaaattgacgcagcctgtgcagaagtccttagtgcaggcagggctgcagacagtgaagagtgagaagaaagcaactgatccgaaggccactcccactctcctggagcagctctctctgctgctcaacattgacatgcccaaaactgaaccgaagggagcagaccctgagtcgcccaggagagaagagatgggctgcaatgctgaccaagagagccagagcggccctggagtaccacaaacccagggtggtgaggtcaagccaaagtcgccagagacagccctggaggcttttaaagccctattcatccggccccccagaaaggggaccacagctgacacctctgagctggaagctctcaagcgcaagatgagacatgagaaggagtcgctaagagctgtgtttgaacggtccaattctaagccagcggatggcccctctgattccaaaagtcctgaccacagcctgactgagcaggatgacaggactcctggcagacttcaagctgtctggccacccccaaagacaaaagacacagaagaaaaagtgggactgaagtacactgaagcagaataccaagctgctattttacacttgaagagggagcacaaagaagaaattgaaaacctgcaggcacagtttgaacttcgggcatttcatatccggggcgagcatgcaatgataacagcgagactagaagaaaccattgaaaatctgaaacacgagctagaacacagatggcgagggggttgtgaagagaggaaagatgtgtgcatttccaccgatgatgactgccctccaaagaccttcagaaatgtgtgcgtccagacagacagagagaccttcctcaagccctgtgaaagtgaaagcaagacaaccagaagtaatcaattagtacccaaaaagctgaatatctcctctttaagccagctctcacccccaaatgaccacaaagacatccatgcagcactccagccaatggagggcatggcatcaaatcagcagaaggcattgcctccgcctcccgcatccatccctccccctccgcccctcccctcaggacttggatctttgtctcccgcacctccaatgccacctgtgagtgctgggccaccgctaccacctccgcctcctccaccgccacctctacctccaccttcaagtgctggacctccaccacccccacccccacccccacttcctaactcccctgccccacccaaccctggagggcctcctcctgctccaccacccccaggacttgcacccccacctccccctggactcttctttggacttggctcttcttccagtcaatgtcctcgaaaaccagccatcgagcccagttgtcccatgaagcctttatattggactaggatacaaataagtgataggagccaaaatgctacaccaaccttatgggactccttagaagaacctgacattcgggaccccagtgaatttgagtatttattctccaaagacacaactcaacagaagaaaaaacctctgtcagagacttatgagaagaaaaacaaggtcaaaaagatcatcaaattgttggatggaaaacgatctcaaactgtgggaatcttgatatctagtttacatttagaaatgaaggatatccaacaggccattttcaatgtggatgactccgtggttgatctggagaccctggcagccttatatgaaaacagagcccaagaggatgagctggttaaaataagaaagtattacgagacatccaaagaagaagaactgaagctgctggataaacctgagcaatttttacatgagttagcccagattcctaattttgctgaacgtgcccagtgcataatcttcagatctgtcttttctgagggtatcacctccttgcacagaaaggtagagatcatcacgcgagcttctaaggacttgctgcacgtgaagagcgtgaaggatattttagctctcatcttggcttttggaaattatatgaatggaggaaataggactcggggacaagccgatggatatagcttagaaattctgcccaaactcaaggatgtcaaaagtcgggataatgggattaatctggtggactacgttgttaagtattacctgcgttactatgatcaggaagctggaacagaaaagagtgttttccccttgccggaaccacaggatttctttctggcctcccaagtcaagtttgaagacctcataaaagatttgagaaaactgaagaggcaactagaagcaagtgagaaacagatggtggtggtgtgcaaggagtccccaaaggagtatctccagcctttcaaggacaaactagaggagttcttccaaaaagctggttcttcatcttcccaatctctaaacacaagagggcttcaggactcagtccatgaaccccttgccttatc

SEQ ID NO: 5233 - DNA, 3707 bp, synthetic construct
  misc_feature 1..3707: note = Synthetic polypeptide
  source 1..3707: mol_type = other DNA
atggaaggcactcattgtaccctccaattgcataagcccattacggaactctgctacatcagcttctgtcttccaaagggggaagtcagaggattttcatacaagggcactgtaactctagacagatccaataaaggttttcataactgctaccaagtcagggaggagtcagacatcatcagcctcagccaggagccggacgaacatccaggcgacatatttttcaagcagactcccacgaaagacattctaactgagctgtacaaactcacaacagagagggagagactgctaaccaatctcctgagctcagaccacatcctggggatcacgatggggaaccaggaggggaagctgcaagagctgtccgtgagcctggcccccgaggatgactgtttccagagtgctggtgactggcagggagagctccccgtgggccctctcaataagaggagcacccacgggaacaaaaagcctcggaggtctagtggaaggagagagagctttggggcccttccacagaagaggaccaaaagaaaagggcgtggaggccgagaatcagctcctctgatgggcaaggacaagatctgttccagccactcccttcctctttctagaacaaggcctaacctttgggtactagaggagaaaggaaatctgctcccgaatggggcacttgcctgctccctgcagaggagagagagctgccccccagatattcccaagacgccagacacagaccttggctttgggagctttgagacggctttcaaggacactgggcttggaagagaagtgctgccccctgactgcagctccacagaggcaggaggggatggcattcggaggccgccgagcgggctggagcatcagcaaacaggtttgtctgaaagtcaccaggaccctgagaagcatccagaggcagaaaaggatgagatggagaagccggctaagcggacttgcaagcagaaacctgtctccaaagtggtggccaaagttcaggacctgtcctcccaggtacaaagagtagttaaaacgcattctaagggtaaggagacgattgccattcgcccagcagcccacgctgagtttgtacccaaagccgacttgctcaccctcccgggagctgaggctggggctcatggctccaggcggcagggcaaggagcggcaaggggataggtcatcgcagtcgccagccggggaaacagcctccatttctagtgtgtcggccagtgccgagggggccgtgaacaaggtccccctgaaggtgatagagagtgagaagttagatgaagcccctgaggggaaaagactgggcttccctgtccacacgagtgtccctcacactcgcccagaaacgagaaacaagaggagagccgggttgccccttggtggccacaagtccttgtttctggatctgccccacaaagtaggtcctgactcctcacaacccagaggtgataagaagaagccatccccaccagcaccggcagctcttggcaaggtgtttaataattcagcctcgcagtccagcacacacaaacagacgtcacctgttccctcgcctctgtctccaaggctccccagccctcagcagcatcacaggatcctccggctccctgcattgcctggtgagagggaagctgctcttaatgactctccttgtagaaagagccgtgtcttctctgggtgcgtctctgctgacaccttggagccaccatcctctgcaaaggtcacggagaccaaaggagccagcccggccttcctcagagcaggccaacctcggttggtgcctggggaaactttggaaaagagcttggggccagggaagaccacagctgagccccagcaccagtcacctccagaataccaagctgctattttacacttgaagagggagcacaaagaagaaattgaaaacctgcaggcacagtttgaacttcgggcatttcatatccggggcgagcatgcaatgataacagcgagactagaagaaaccattgaaaatctgaaacacgagctagaacacagatggcgagggggttgtgaagagaggaaagatgtgtgcatttccaccgatgatgactgccctccaaagaccttcagaaatgtgtgcgtccagacagacagagagaccttcctcaagccctgtgaaagtgaaagcaagacaaccagaagtaatcaattagtacccaaaaagctgaatatctcctctttaagccagctctcacccccaaatgaccacaaagacatccatgcagcactccagccaatggagggcatggcatcaaatcagcagaaggcattgcctccgcctcccgcatccatccctccccctccgcccctcccctcaggacttggatctttgtctcccgcacctccaatgccacctgtgagtgctgggccaccgctaccacctccgcctcctccaccgccacctctacctccaccttcaagtgctggacctccaccacccccacccccacccccacttcctaactcccctgccccacccaaccctggagggcctcctcctgctccaccacccccaggacttgcacccccacctccccctggactcttctttggacttggctcttcttccagtcaatgtcctcgaaaaccagccatcgagcccagttgtcccatgaagcctttatattggactaggatacaaataagtgataggagccaaaatgctacaccaaccttatgggactccttagaagaacctgacattcgggaccccagtgaatttgagtatttattctccaaagacacaactcaacagaagaaaaaacctctgtcagagacttatgagaagaaaaacaaggtcaaaaagatcatcaaattgttggatggaaaacgatctcaaactgtgggaatcttgatatctagtttacatttagaaatgaaggatatccaacaggccattttcaatgtggatgactccgtggttgatctggagaccctggcagccttatatgaaaacagagcccaagaggatgagctggttaaaataagaaagtattacgagacatccaaagaagaagaactgaagctgctggataaacctgagcaatttttacatgagttagcccagattcctaattttgctgaacgtgcccagtgcataatcttcagatctgtcttttctgagggtatcacctccttgcacagaaaggtagagatcatcacgcgagcttctaaggacttgctgcacgtgaagagcgtgaaggatattttagctctcatcttggcttttggaaattatatgaatggaggaaataggactcggggacaagccgatggatatagcttagaaattctgcccaaactcaaggatgtcaaaagtcgggataatgggattaatctggtggactacgttgttaagtattacctgcgttactatgatcaggaagctggaacagaaaagagtgttttccccttgccggaaccacaggatttctttctggcctcccaagtcaagtttgaagacctcataaaagatttgagaaaactgaagaggcaactagaagcaagtgagaaacagatggtggtggtgtgcaaggagtccccaaaggagtatctccagcctttcaaggacaaactagaggagttcttccaaaaagctggttcttcatcttcccaatctctaaacacaagagggcttcaggactcagtccatgaaccccttgccttatc

SEQ ID NO: 5234 - DNA, 4001 bp, synthetic construct
  misc_feature 1..4001: note = Synthetic polypeptide
  source 1..4001: mol_type = other DNA
atggaaggcactcattgtaccctccaattgcataagcccattacggaactctgctacatcagcttctgtcttccaaagggggaagtcagaggattttcatacaagggcactgtaactctagacagatccaataaaggttttcataactgctaccaagtcagggaggagtcagacatcatcagcctcagccaggagccggacgaacatccaggcgacatatttttcaagcagactcccacgaaagacattctaactgagctgtacaaactcacaacagagagggagagactgctaaccaatctcctgagctcagaccacatcctggggatcacgatggggaaccaggaggggaagctgcaagagctgtccgtgagcctggcccccgaggatgactgtttccagagtgctggtgactggcagggagagctccccgtgggccctctcaataagaggagcacccacgggaacaaaaagcctcggaggtctagtggaaggagagagagctttggggcccttccacagaagaggaccaaaagaaaagggcgtggaggccgagaatcagctcctctgatgggcaaggacaagatctgttccagccactcccttcctctttctagaacaaggcctaacctttgggtactagaggagaaaggaaatctgctcccgaatggggcacttgcctgctccctgcagaggagagagagctgccccccagatattcccaagacgccagacacagaccttggctttgggagctttgagacggctttcaaggacactgggcttggaagagaagtgctgccccctgactgcagctccacagaggcaggaggggatggcattcggaggccgccgagcgggctggagcatcagcaaacaggtttgtctgaaagtcaccaggaccctgagaagcatccagaggcagaaaaggatgagatggagaagccggctaagcggacttgcaagcagaaacctgtctccaaagtggtggccaaagttcaggacctgtcctcccaggtacaaagagtagttaaaacgcattctaagggtaaggagacgattgccattcgcccagcagcccacgctgagtttgtacccaaagccgacttgctcaccctcccgggagctgaggctggggctcatggctccaggcggcagggcaaggagcggcaaggggataggtcatcgcagtcgccagccggggaaacagcctccatttctagtgtgtcggccagtgccgagggggccgtgaacaaggtccccctgaaggtgatagagagtgagaagttagatgaagcccctgaggggaaaagactgggcttccctgtccacacgagtgtccctcacactcgcccagaaacgagaaacaagaggagagccgggttgccccttggtggccacaagtccttgtttctggatctgccccacaaagtaggtcctgactcctcacaacccagaggtgataagaagaagccatccccaccagcaccggcagctcttggcaaggtgtttaataattcagcctcgcagtccagcacacacaaacagacgtcacctgttccctcgcctctgtctccaaggctccccagccctcagcagcatcacaggatcctccggctccctgcattgcctggtgagagggaagctgctcttaatgactctccttgtagaaagagccgtgtcttctctgggtgcgtctctgctgacaccttggagccaccatcctctgcaaaggtcacggagaccaaaggagccagcccggccttcctcagagcaggccaacctcggttggtgcctggggaaactttggaaaagagcttggggccagggaagaccacagctgagccccagcaccagtcacctccaggtatctcctctgagggctttccctgggacggcttcaatgagcagacacctaaagaccttcccaacagagatggaggcgcgtgggttctgggctacagagcgggaccagcctgtccatttttgcttcatgaggaaagggagaagtcaaacaggagcgaattgtacttggatctccatcctgaccacagcctgactgagcaggatgacaggactcctggcagacttcaagctgtctggccacccccaaagacaaaagacacagaagaaaaagtgggactgaagtacactgaagcagaataccaagctgctattttacacttgaagagggagcacaaagaagaaattgaaaacctgcaggcacagtttgaacttcgggcatttcatatccggggcgagcatgcaatgataacagcgagactagaagaaaccattgaaaatctgaaacacgagctagaacacagatggcgagggggttgtgaagagaggaaagatgtgtgcatttccaccgatgatgactgccctccaaagaccttcagaaatgtgtgcgtccagacagacagagagaccttcctcaagccctgtgaaagtgaaagcaagacaaccagaagtaatcaattagtacccaaaaagctgaatatctcctctttaagccagctctcacccccaaatgaccacaaagacatccatgcagcactccagccaatggagggcatggcatcaaatcagcagaaggcattgcctccgcctcccgcatccatccctccccctccgcccctcccctcaggacttggatctttgtctcccgcacctccaatgccacctgtgagtgctgggccaccgctaccacctccgcctcctccaccgccacctctacctccaccttcaagtgctggacctccaccacccccacccccacccccacttcctaactcccctgccccacccaaccctggagggcctcctcctgctccaccacccccaggacttgcacccccacctccccctggactcttctttggacttggctcttcttccagtcaatgtcctcgaaaaccagccatcgagcccagttgtcccatgaagcctttatattggactaggatacaaataagtgataggagccaaaatgctacaccaaccttatgggactccttagaagaacctgacattcgggaccccagtgaatttgagtatttattctccaaagacacaactcaacagaagaaaaaacctctgtcagagacttatgagaagaaaaacaaggtcaaaaagatcatcaaattgttggatggaaaacgatctcaaactgtgggaatcttgatatctagtttacatttagaaatgaaggatatccaacaggccattttcaatgtggatgactccgtggttgatctggagaccctggcagccttatatgaaaacagagcccaagaggatgagctggttaaaataagaaagtattacgagacatccaaagaagaagaactgaagctgctggataaacctgagcaatttttacatgagttagcccagattcctaattttgctgaacgtgcccagtgcataatcttcagatctgtcttttctgagggtatcacctccttgcacagaaaggtagagatcatcacgcgagcttctaaggacttgctgcacgtgaagagcgtgaaggatattttagctctcatcttggcttttggaaattatatgaatggaggaaataggactcggggacaagccgatggatatagcttagaaattctgcccaaactcaaggatgtcaaaagtcgggataatgggattaatctggtggactacgttgttaagtattacctgcgttactatgatcaggaagctggaacagaaaagagtgttttccccttgccggaaccacaggatttctttctggcctcccaagtcaagtttgaagacctcataaaagatttgagaaaactgaagaggcaactagaagcaagtgagaaacagatggtggtggtgtgcaaggagtccccaaaggagtatctccagcctttcaaggacaaactagaggagttcttccaaaaagctggttcttcatcttcccaatctctaaacacaagagggcttcaggactcagtccatgaaccccttgccttatc

SEQ ID NO: 5235 - DNA, 249 bp, synthetic construct
  misc_feature 1..249: note = Synthetic polypeptide
  source 1..249: mol_type = other DNA
accacaggatttctttctggcctcccaagtcaagtttgaagacctcataaaagatttgagaaaactgaagaggcaactagaagcaagtgagaaacagatggtggtggtgtgcaaggagtccccaaaggagtatctccagcctttcaaggacaaactagaggagttcttccaaaaagctggttcttcatcttcccaatctctaaacacaagagggcttcaggactcagtccatgaaccccttgccttatc

SEQ ID NO: 5236 - DNA, 516 bp, synthetic construct
  misc_feature 1..516: note = Synthetic polypeptide
  source 1..516: mol_type = other DNA
atgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaaggacatgcagagagacaccagggatgtgcgcagagggaccgccatgtgaagaagcagcaagaggagcaagaggacggccatctgcaagccaagggggaagccacctgcccacaccttgatctgagacttccggcctccacaaccgtgagaagatacgtgtccgttgtttaagctgcccagtctgcggtgctttgttctggcagcc

SEQ ID NO: 5237 - DNA, 48 bp, synthetic construct
  misc_feature 1..48: note = Synthetic polypeptide
  source 1..48: mol_type = other DNA
atgtttggcactgaatcttcatagaaaaatatttgttgaatgagtgaa

SEQ ID NO: 5238 - DNA, 2161 bp, synthetic construct; identical to SEQ ID NO: 288
  misc_feature 1..2161: note = Synthetic polypeptide
  source 1..2161: mol_type = other DNA

SEQ ID NO: 5239 - DNA, 2140 bp, synthetic construct; identical to SEQ ID NO: 289
  misc_feature 1..2140: note = Synthetic polypeptide
  source 1..2140: mol_type = other DNA

SEQ ID NO: 5240 - DNA, 529 bp, synthetic construct; identical to SEQ ID NO: 287
  misc_feature 1..529: note = Synthetic polypeptide
  source 1..529: mol_type = other DNA

SEQ ID NO: 5241 - DNA, 550 bp, synthetic construct; identical to SEQ ID NO: 3092
  misc_feature 1..550: note = Synthetic polypeptide
  source 1..550: mol_type = other DNA

SEQ ID NO: 5242 - DNA, 412 bp, synthetic construct; identical to SEQ ID NO: 3093
  misc_feature 1..412: note = Synthetic polypeptide
  source 1..412: mol_type = other DNA

SEQ ID NO: 5243 - DNA, 798 bp, synthetic construct; identical to SEQ ID NO: 3839
  misc_feature 1..798: note = Synthetic polypeptide
  source 1..798: mol_type = other DNA

SEQ ID NO: 5244 - DNA, 609 bp, synthetic construct; identical to SEQ ID NO: 249
  misc_feature 1..609: note = Synthetic polypeptide
  source 1..609: mol_type = other DNA

SEQ ID NO: 5245 - DNA, 738 bp, synthetic construct; identical to SEQ ID NO: 250
  misc_feature 1..738: note = Synthetic polypeptide
  source 1..738: mol_type = other DNA

SEQ ID NO: 5246 - DNA, 537 bp, synthetic construct; identical to SEQ ID NO: 251
  misc_feature 1..537: note = Synthetic polypeptide
  source 1..537: mol_type = other DNA

SEQ ID NO: 5247 - DNA, 684 bp, synthetic construct; identical to SEQ ID NO: 253
  misc_feature 1..684: note = Synthetic polypeptide
  source 1..684: mol_type = other DNA

SEQ ID NO: 5248 - DNA, 285 bp, synthetic construct; identical to SEQ ID NO: 255
  misc_feature 1..285: note = Synthetic polypeptide
  source 1..285: mol_type = other DNA

SEQ ID NO: 5249 - DNA, 552 bp, synthetic construct; identical to SEQ ID NO: 254
  misc_feature 1..552: note = Synthetic polypeptide
  source 1..552: mol_type = other DNA

SEQ ID NO: 5250 - DNA, 344 bp, synthetic construct; identical to SEQ ID NO: 5133
  misc_feature 1..344: note = Synthetic polypeptide
  source 1..344: mol_type = other DNA

SEQ ID NO: 5251 - DNA, 775 bp, synthetic construct; identical to SEQ ID NO: 215
  misc_feature 1..775: note = Synthetic polypeptide
  source 1..775: mol_type = other DNA

SEQ ID NO: 5252 - DNA, 1823 bp, synthetic construct; identical to SEQ ID NO: 2096
  misc_feature 1..1823: note = Synthetic polypeptide
  source 1..1823: mol_type = other DNA

SEQ ID NO: 5253 - DNA, 1859 bp, synthetic construct; identical to SEQ ID NO: 2097
  misc_feature 1..1859: note = Synthetic polypeptide
  source 1..1859: mol_type = other DNA

SEQ ID NO: 5254 - DNA, 1526 bp, synthetic construct; identical to SEQ ID NO: 2098
  misc_feature 1..1526: note = Synthetic polypeptide
  source 1..1526: mol_type = other DNA

SEQ ID NO: 5255 - DNA, 1685 bp, synthetic construct; identical to SEQ ID NO: 2099
  misc_feature 1..1685: note = Synthetic polypeptide
  source 1..1685: mol_type = other DNA

SEQ ID NO: 5256 - DNA, 503 bp, synthetic construct
  misc_feature 1..503: note = Synthetic polypeptide
  source 1..503: mol_type = other DNA
atggccagcccttccggcagctccgaagccactggcaagccccgaggcagggatggccggcccaggagggaagaggacgacgtccctcccgaagagaagaggctgcggctgttgctggaggggggaagcgcagaacctgaggactgcgaggacggggaggacgtgccgcggccaggcagggaggagaccgggacccagacaggtggcgacggcagaggagcgcagtggctcacacctgtaatcctagcactttgggaggccaaggcgggtggatcgtgaggtcaggagttcgggaccagcctggccaatatggtgaaaccccatcactactaaaaatacaaaaattagccaggcacggtggtgtgtgcctgtagtcccagttacttgggaggctgaggcagaagaatctcttgaacccaggagagaggttgcagtgagccgagatcgtgccactgcactccagcctgggtaacaaagcaagactccatctcaaaaataaaaaa

SEQ ID NO: 5257 - DNA, 1855 bp, synthetic construct
  misc_feature 1..1855: note = Synthetic polypeptide
  source 1..1855: mol_type = other DNA
atgcgacctgtcagtgtctggcagtggagcccctgggggctgctgctgtgcctgctgtgcagttcgtgcttggggtctccgtccccttccacgggccctgagaagaaggccgggagccaggggcttcggttccggctggctggcttccccaggaagccctacgagggccgcgtggagatacagcgagctggtgaatggggcaccatctgcgatgatgacttcacgctgcaggctgcccacatcctctgccgggagctgggcttcacagaggccacaggctggacccacagtgccaaatatggccctggaacaggccgcatctggctggacaacttgagctgcagtgggaccgagcagagtgtgactgaatgtgcctcccggggctgggggaacagtgactgtacgcacgatgaggatgctggggtcatctgcaaagaccagcgcctccctggcttctcggactccaatgtcattgaggtagagcatcacctgcaagtggaggaggtgcgaattcgacccgccgttgggtggggcagacgacccctgcccgtgacggaggggctggtggaagtcaggcttcctgacggctggtcgcaagtgtgcgacaaaggctggagcgcccacaacagccacgtggtctgcgggatgctgggcttccccagcgaaaagagggtcaacgcggccttctacaggctgctagcccaacggcagcaacactcctttggtctgcatggggtggcgtgcgtgggcacggaggcccacctctccctctgttccctggagttctatcgtgccaatgacaccgccaggtgccctggggggggccctgcagtggtgagctgtgtgccaggccctgtctacgcggcatccagtggccagaagaagcaacaacagtcgaagcctcagggggaggcccgtgtccgtctaaagggcggcgcccaccctggagagggccgggtagaagtcctgaaggccagcacatggggcacagtctgtgaccgcaagtgggacctgcatgcagccagcgtggtgtgtcgggagctgggcttcgggagtgctcgagaagctctgagtggcgctcgcatggggcagggcatgggtgctatccacctgagtgaagttcgctgctctggacaggagctctccctctggaagtgcccccacaagaacatcacagctgaggattgttcacatagccaggatgccggggtccggtgcaacctaccttacactggggcagagaccaggatccgactcagtgggggccgcagccaacatgaggggcgagtcgaggtgcaaatagggggacctgggccccttcgctggggcctcatctgtggggatgactgggggaccctggaggccatggtggcctgtaggcaactgggtctgggctacgccaaccacggcctgcaggagacctggtactgggactctgggaatataacagaggtggtgatgagtggagtgcgctgcacagggactgagctgtccctggatcagtgtgcccatcatggcacccacatcacctgcaagaggacagggacccgcttcactgctggagtcatctgttctgagacactttaggaggccaaggcggatggatcacgaggtcaggaattcaagaccagcctgaccaagatggtgaaaccctgtctctactaaaactacaaaaattagccaggcgcagtggcaggcgcctataatcccagctactcgggaggctgaggcaggagaatcacttgaacccaggtggcagaggttgcagtgagccaagatcacgccgctgcattccagcctcggcaacagagtgagactccatctcaaacaaacaaacaaacaaaaacaaaaacaa

SEQ ID NO: 5258 - DNA, 1420 bp, synthetic construct
  misc_feature 1..1420: note = Synthetic polypeptide
  source 1..1420: mol_type = other DNA
atgcgacctgtcagtgtctggcagtggagcccctgggggctgctgctgtgcctgctgtgcagttcgtgcttggggtctccgtccccttccacgggccctgagaagaaggccgggagccaggggcttcggttccggctggctggcttccccaggaagccctacgagggccgcgtggagatacagcgagctggtgaatggggcaccatctgcgatgatgacttcacgctgcaggctgcccacatcctctgccgggagctgggcttcacagaggccacaggctggacccacagtgccaaatatggccctggaacaggccgcatctggctggacaacttgagctgcagtgggaccgagcagagtgtgactgaatgtgcctcccggggctgggggaacagtgactgtacgcacgatgaggatgctggggtcatctgcaaagaccagcgcctccctggcttctcggactccaatgtcattgaggcccgtgtccgtctaaagggcggcgcccaccctggagagggccgggtagaagtcctgaaggccagcacatggggcacagtctgtgaccgcaagtgggacctgcatgcagccagcgtggtgtgtcgggagctgggcttcgggagtgctcgagaagctctgagtggcgctcgcatggggcagggcatgggtgctatccacctgagtgaagttcgctgctctggacaggagctctccctctggaagtgcccccacaagaacatcacagctgaggattgttcacatagccaggatgccggggtccggtgcaacctaccttacactggggcagagaccaggatccgactcagtgggggccgcagccaacatgaggggcgagtcgaggtgcaaatagggggacctgggccccttcgctggggcctcatctgtggggatgactgggggaccctggaggccatggtggcctgtaggcaactgggtctgggctacgccaaccacggcctgcaggagacctggtactgggactctgggaatataacagaggtggtgatgagtggagtgcgctgcacagggactgagctgtccctggatcagtgtgcccatcatggcacccacatcacctgcaagaggacagggacccgcttcactgctggagtcatctgttctgagacactttaggaggccaaggcggatggatcacgaggtcaggaattcaagaccagcctgaccaagatggtgaaaccctgtctctactaaaactacaaaaattagccaggcgcagtggcaggcgcctataatcccagctactcgggaggctgaggcaggagaatcacttgaacccaggtggcagaggttgcagtgagccaagatcacgccgctgcattccagcctcggcaacagagtgagactccatctcaaacaaacaaacaaacaaaaacaaaaacaa

SEQ ID NO: 5259 - DNA, 1687 bp, synthetic construct
  misc_feature 1..1687: note = Synthetic polypeptide
  source 1..1687: mol_type = other DNA
atgcgacctgtcagtgtctggcagtggagcccctgggggctgctgctgtgcctgctgtgcagttcgtgcttggggtctccgtccccttccacgggccctgagaagaaggccgggagccaggggcttcggttccggctggctggcttccccaggaagccctacgagggccgcgtggagatacagcgagctggtgaatggggcaccatctgcgatgatgacttcacgctgcaggctgcccacatcctctgccgggagctgggcttcacagaggccacaggctggacccacagtgccaaatatggccctggaacaggccgcatctggctggacaacttgagctgcagtgggaccgagcagagtgtgactgaatgtgcctcccggggctgggggaacagtgactgtacgcacgatgaggatgctggggtcatctgcaaagaccagcgcctccctggcttctcggactccaatgtcattgaggtagagcatcacctgcaagtggaggaggtgcgaattcgacccgccgttgggtggggcagacgacccctgcccgtgacggaggggctggtggaagtcaggcttcctgacggctggtcgcaagtgtgcgacaaaggctggagcgcccacaacagccacgtggtctgcgggatgctgggcttccccagcgaaaagagggtcaacgcggccttctacaggctgctagcccaacggcagcaacactcctttggtctgcatggggtggcgtgcgtgggcacggaggcccacctctccctctgttccctggagttctatcgtgccaatgacaccgccaggtgccctggggggggccctgcagtggtgagctgtgtgccaggccctgtctacgcggcatccagtggccagaagaagcaacaacagtcgaagcctcagggggaggcccgtgtccgtctaaagggcggcgcccaccctggagagggccgggtagaagtcctgaaggccagcacatggggcacagtctgtgaccgcaagtgggacctgcatgcagccagcgtggtgtgtcgggagctgggcttcgggagtgctcgagaagctctgagtggcgctcgcatggggcagggcatgggtgctatccacctgagtgaagttcgctgctctggacaggagctctccctctggaagtgcccccacaagaacatcacagctgaggattgttcacatagccaggatgccggggtccggtgcaacctaccttacactggggcagagaccagggagacctggtactgggactctgggaatataacagaggtggtgatgagtggagtgcgctgcacagggactgagctgtccctggatcagtgtgcccatcatggcacccacatcacctgcaagaggacagggacccgcttcactgctggagtcatctgttctgagacactttaggaggccaaggcggatggatcacgaggtcaggaattcaagaccagcctgaccaagatggtgaaaccctgtctctactaaaactacaaaaattagccaggcgcagtggcaggcgcctataatcccagctactcgggaggctgaggcaggagaatcacttgaacccaggtggcagaggttgcagtgagccaagatcacgccgctgcattccagcctcggcaacagagtgagactccatctcaaacaaacaaacaaacaaaaacaaaaacaa

SEQ ID NO: 5260 - DNA, 1452 bp, synthetic construct; identical to SEQ ID NO: 3717
  misc_feature 1..1452: note = Synthetic polypeptide
  source 1..1452: mol_type = other DNA

SEQ ID NO: 5261 - DNA, 1155 bp, synthetic construct; identical to SEQ ID NO: 3718
  misc_feature 1..1155: note = Synthetic polypeptide
  source 1..1155: mol_type = other DNA

SEQ ID NO: 5262 - DNA, 1278 bp, synthetic construct; identical to SEQ ID NO: 3719
  misc_feature 1..1278: note = Synthetic polypeptide
  source 1..1278: mol_type = other DNA

SEQ ID NO: 5263 - DNA, 558 bp, synthetic construct; identical to SEQ ID NO: 2797
  misc_feature 1..558: note = Synthetic polypeptide
  source 1..558: mol_type = other DNA

SEQ ID NO: 5264 - DNA, 214 bp, synthetic construct
  misc_feature 1..214: note = Synthetic polypeptide
  source 1..214: mol_type = other DNA
atgtggtcgacgagaagccccaacagcacggcgtggcctctcagcctcgatccccttctgctttttgccatgagtgggagcagtatgaggccctcaccagatgcagctgcccaatttggacttcccagccactagaactgtgagccaaacaaacctctcttctttacaaattacccaagtattcagctatagcaactcaaattggactgagaca

SEQ ID NO: 5265 - DNA, 1601 bp, synthetic construct
  misc_feature 1..1601: note = Synthetic polypeptide
  source 1..1601: mol_type = other DNA
atggcgttcaggagacaagtgaaaaactttgtgaaaaattactcagatgctgaaataaaagtcagggaagcaacttctaacgacccttggggtccctctagttctctgatgttagatatcagtgacttgactttcaacacaatttctctctcagagattatgaatatgctgtggcacagactcaatgaccatgggaagaactggcgccacgtgtataaatcccttaccctaatggattatctcatcaagaatggatcaaagaaagttattcagcattgcagagaggggttctgtaaccttcaaacactaaaagattttcagcacatagatgaagctggaaaagaccaaggttattatatccgggaaaaatctaagcaagtcatcacattgctgatggatgaaccattgctgtgtaaagagagggaagtggcatgtcggactagacagcgtacctcccactctatattgttttctaaaagacaacttggttcaagtaactcactgacagcgtgcacttctgcccccacaccggatatttctgcttcagagaagaagtataagcttcctaagtttggaaggttacataataaaacccatggatcaaggagtgatttcaactttcaagtcttattactgaagaaatacatttcataaagctatatcttccatagatagtgattcctctgatggatctgagcaaagtaaattaaaaaccttctggaaaagattcaccactctagatgccattaagaacatttgtgattcatgggaggaagccaaaatttcaacattaacaggagtttgaaagaagtggattccaacccttatggatgactttgaggggttcaagacttcagtggaggaaggaactgcagatgtggcggaaatagcaagagaactagaattagaagtggagcctgaagatgtgactggattgctgcaatctcatgatcaaacttgaacagatgaggagatacttcttatggatgagcaaagaaaatggtttcttgagttgaaatctactcctgtgaagaagctgtgaacattgttgcaatgccaacaaagaattcagaatattacataaacttagtaaataaaccagtggcaggattagagaggattgactccaattttgaaagaagttctactgtgggtaaaatgctatcaaacagcatcacatgctacagataaatcttttgtgaaaggaagagtcagttgatgttgcaggctttattgttgtcttactttaaaaaattgccacagctttcccaaccttcagcagcaaccaccctgatctatcagcagccctcaacatggagacaagaccctccaccagcaaaaagatgaagactcgctgaaggctcagatgattgttagcctttttaaattagcaataaagtattatttaattatgtatatatattttttaggcagcatggtattgcatacttagtctactaagtagactgcagtctaatgtaaacataacttttatatgcactgggaaacaaaaatgtttgtgtgagtggctttattggaatatttgctttattgcagtaatctggaacccagcccaccgcagtatcttcaaggtgtgcctg

SEQ ID NO: 5266 - DNA, 118 bp, synthetic construct; identical to SEQ ID NO: 4271
  misc_feature 1..118: note = Synthetic polypeptide
  source 1..118: mol_type = other DNA

SEQ ID NO: 5267 - DNA, 1273 bp, synthetic construct; identical to SEQ ID NO: 1927
  misc_feature 1..1273: note = Synthetic polypeptide
  source 1..1273: mol_type = other DNA

SEQ ID NO: 5268 - DNA, 1516 bp, synthetic construct; identical to SEQ ID NO: 1928
  misc_feature 1..1516: note = Synthetic polypeptide
  source 1..1516: mol_type = other DNA

SEQ ID NO: 5269 - DNA, 1393 bp, synthetic construct; identical to SEQ ID NO: 1929
  misc_feature 1..1393: note = Synthetic polypeptide
  source 1..1393: mol_type = other DNA

SEQ ID NO: 5270 - DNA, 1146 bp, synthetic construct; identical to SEQ ID NO: 988
  misc_feature 1..1146: note = Synthetic polypeptide
  source 1..1146: mol_type = other DNA

SEQ ID NO: 5271 - DNA, 412 bp, synthetic construct; identical to SEQ ID NO: 1704
  misc_feature 1..412: note = Synthetic polypeptide
  source 1..412: mol_type = other DNA

SEQ ID NO: 5272 - DNA, 487 bp, synthetic construct; identical to SEQ ID NO: 918
  misc_feature 1..487: note = Synthetic polypeptide
  source 1..487: mol_type = other DNA

SEQ ID NO: 5273 - DNA, 254 bp, synthetic construct; identical to SEQ ID NO: 1993
  misc_feature 1..254: note = Synthetic polypeptide
  source 1..254: mol_type = other DNA

SEQ ID NO: 5274 - DNA, 1398 bp, synthetic construct; identical to SEQ ID NO: 948
  misc_feature 1..1398: note = Synthetic polypeptide
  source 1..1398: mol_type = other DNA

SEQ ID NO: 5275 - DNA, 1302 bp, synthetic construct; identical to SEQ ID NO: 949
  misc_feature 1..1302: note = Synthetic polypeptide
  source 1..1302: mol_type = other DNA

SEQ ID NO: 5276 - DNA, 640 bp, synthetic construct; identical to SEQ ID NO: 1700
  misc_feature 1..640: note = Synthetic polypeptide
  source 1..640: mol_type = other DNA

SEQ ID NO: 5277 - DNA, 1391 bp, synthetic construct; identical to SEQ ID NO: 1950
  misc_feature 1..1391: note = Synthetic polypeptide
  source 1..1391: mol_type = other DNA

SEQ ID NO: 5278 - DNA, 1394 bp, synthetic construct; identical to SEQ ID NO: 1951
  misc_feature 1..1394: note = Synthetic polypeptide
  source 1..1394: mol_type = other DNA

SEQ ID NO: 5279 - DNA, 385 bp, synthetic construct; identical to SEQ ID NO: 1938
  misc_feature 1..385: note = Synthetic polypeptide
  source 1..385: mol_type = other DNA

SEQ ID NO: 5280 - DNA, 1058 bp, synthetic construct; identical to SEQ ID NO: 1966
  misc_feature 1..1058: note = Synthetic polypeptide
  source 1..1058: mol_type = other DNA

SEQ ID NO: 5281 - DNA, 725 bp, synthetic construct; identical to SEQ ID NO: 1705
  misc_feature 1..725: note = Synthetic polypeptide
  source 1..725: mol_type = other DNA

SEQ ID NO: 5282 - DNA, 815 bp, synthetic construct; identical to SEQ ID NO: 1706
  misc_feature 1..815: note = Synthetic polypeptide
  source 1..815: mol_type = other DNA

SEQ ID NO: 5283 - DNA, 361 bp, synthetic construct; identical to SEQ ID NO: 1916
  misc_feature 1..361: note = Synthetic polypeptide
  source 1..361: mol_type = other DNA

SEQ ID NO: 5284 - DNA, 575 bp, synthetic construct; identical to SEQ ID NO: 2296
  misc_feature 1..575: note = Synthetic polypeptide
  source 1..575: mol_type = other DNA

SEQ ID NO: 5285 - DNA, 100 bp, synthetic construct
  misc_feature 1..100: note = Synthetic polypeptide
  source 1..100: mol_type = other DNA
atgatggctcagtttcccacagctatgaatggttaatgctgggggctcagtgagttgctgcatataaagtccctgacaatagtcagggttcaataaaggt

SEQ ID NO: 5286 - DNA, 1231 bp, synthetic construct; identical to SEQ ID NO: 1238
  misc_feature 1..1231: note = Synthetic polypeptide
  source 1..1231: mol_type = other DNA

SEQ ID NO: 5287 - DNA, 823 bp, synthetic construct; identical to SEQ ID NO: 1941
  misc_feature 1..823: note = Synthetic polypeptide
  source 1..823: mol_type = other DNA

SEQ ID NO: 5288 - DNA, 715 bp, synthetic construct; identical to SEQ ID NO: 1942
  misc_feature 1..715: note = Synthetic polypeptide
  source 1..715: mol_type = other DNA

SEQ ID NO: 5289 - DNA, 299 bp, synthetic construct; identical to SEQ ID NO: 1943
  misc_feature 1..299: note = Synthetic polypeptide
  source 1..299: mol_type = other DNA

SEQ ID NO: 5290 - DNA, 148 bp, synthetic construct; identical to SEQ ID NO: 1944
  misc_feature 1..148: note = Synthetic polypeptide
  source 1..148: mol_type = other DNA

SEQ ID NO: 5291 - DNA, 578 bp, synthetic construct; identical to SEQ ID NO: 1946
  misc_feature 1..578: note = Synthetic polypeptide
  source 1..578: mol_type = other DNA

SEQ ID NO: 5292 - DNA, 488 bp, synthetic construct; identical to SEQ ID NO: 1947
  misc_feature 1..488: note = Synthetic polypeptide
  source 1..488: mol_type = other DNA

SEQ ID NO: 5293 - DNA, 479 bp, synthetic construct; identical to SEQ ID NO: 1948
  misc_feature 1..479: note = Synthetic polypeptide
  source 1..479: mol_type = other DNA

SEQ ID NO: 5294 - DNA, 470 bp, synthetic construct; identical to SEQ ID NO: 1949
  misc_feature 1..470: note = Synthetic polypeptide
  source 1..470: mol_type = other DNA

SEQ ID NO: 5295 - DNA, 3093 bp, synthetic construct; identical to SEQ ID NO: 341
  misc_feature 1..3093: note = Synthetic polypeptide
  source 1..3093: mol_type = other DNA

SEQ ID NO: 5296 - DNA, 2979 bp, synthetic construct; identical to SEQ ID NO: 342
  misc_feature 1..2979: note = Synthetic polypeptide
  source 1..2979: mol_type = other DNA

SEQ ID NO: 5297 - DNA, 3078 bp, synthetic construct; identical to SEQ ID NO: 343
  misc_feature 1..3078: note = Synthetic polypeptide
  source 1..3078: mol_type = other DNA

SEQ ID NO: 5298 - DNA, 3072 bp, synthetic construct; identical to SEQ ID NO: 346
  misc_feature 1..3072: note = Synthetic polypeptide
  source 1..3072: mol_type = other DNA

SEQ ID NO: 5299 - DNA, 1935 bp, synthetic construct; identical to SEQ ID NO: 347
  misc_feature 1..1935: note = Synthetic polypeptide
  source 1..1935: mol_type = other DNA

SEQ ID NO: 5300 - DNA, 1096 bp, synthetic construct; identical to SEQ ID NO: 348
  misc_feature 1..1096: note = Synthetic polypeptide
  source 1..1096: mol_type = other DNA

SEQ ID NO: 5301 - DNA, 902 bp, synthetic construct; identical to SEQ ID NO: 349
  misc_feature 1..902: note = Synthetic polypeptide
  source 1..902: mol_type = other DNA

SEQ ID NO: 5302 - DNA, 874 bp, synthetic construct; identical to SEQ ID NO: 350
  misc_feature 1..874: note = Synthetic polypeptide
  source 1..874: mol_type = other DNA

SEQ ID NO: 5303 - DNA, 314 bp, synthetic construct; identical to SEQ ID NO: 998
  misc_feature 1..314: note = Synthetic polypeptide
  source 1..314: mol_type = other DNA

SEQ ID NO: 5304 - DNA, 193 bp, synthetic construct; identical to SEQ ID NO: 975
  misc_feature 1..193: note = Synthetic polypeptide
  source 1..193: mol_type = other DNA

SEQ ID NO: 5305 - DNA, 1705 bp, synthetic construct; identical to SEQ ID NO: 1989
  misc_feature 1..1705: note = Synthetic polypeptide
  source 1..1705: mol_type = other DNA

SEQ ID NO: 5306 - DNA, 873 bp, synthetic construct
  misc_feature 1..873: note = Synthetic polypeptide
  source 1..873: mol_type = other DNA
atggggctgtttggaaagacccaggagaagccgcccaaagaactggtcaatgagtggtcattgaagataagaaaggaaatgagagttgttgacaggcaaataaggggatccattggagtctttggctgaatactaagctgtgcatgcttagagtgaaatttcaagagactgggcaaagaacaattactaggaacagaacaactaccaggaagctgtaagctgaataattcttagagctaataaaggattgagaagtggttgagctctgatcagacacagaaaagagactttgttgaacctctgggatgttcaatagagacctcagaagagtcacaccttaataataaggatcaggtaggtagtcctagaaaaaaggctaccacaagcccataccaaccaaccaacaagacttaaaagacttcacggctgatttgcaggtaatttgactgcctgccaaagtaaagattaacactgtttaagggaagactacaaaatgcaggcacccaacaatgaaacatatacagtggccagcatccaataagatactattatgaagaagcaggaaaatgtgaccccaaaacaggagaaaagccaggtaatagaaatagatttaaaaaaaaaaaacacccaaaacccccacaaaaaaagatgattgaatttgcagtcaaggatttttaagcagctattataaatatgttgagattaaaggataacttaaacataatgaggagataaatacaaaatacagaaaacaacaaaatggaatttctagagttgaaagatctgaaatgaagtgaaattaaatgaagaatcactgaatgggtttaacagcaaattagacactacagaaaacaagatcagtgaaattgaaga

SEQ ID NO: 5307 - DNA, 960 bp, synthetic construct
  misc_feature 1..960: note = Synthetic polypeptide
  source 1..960: mol_type = other DNA
atggagggtgagctctattctgctctcaaggaagaagaagcatccgaatcggtttctagtaccaatttcagtggtgaaatgcacttctatgagcttgtggaagacacaaaagatggcatctggctggttcaggtcaatgagtggtcattgaagataagaaaggaaatgagagttgttgacaggcaaataaggggatccattggagtctttggctgaatactaagctgtgcatgcttagagtgaaatttcaagagactgggcaaagaacaattactaggaacagaacaactaccaggaagctgtaagctgaataattcttagagctaataaaggattgagaagtggttgagctctgatcagacacagaaaagagactttgttgaacctctgggatgttcaatagagacctcagaagagtcacaccttaataataaggatcaggtaggtagtcctagaaaaaaggctaccacaagcccataccaaccaaccaacaagacttaaaagacttcacggctgatttgcaggtaatttgactgcctgccaaagtaaagattaacactgtttaagggaagactacaaaatgcaggcacccaacaatgaaacatatacagtggccagcatccaataagatactattatgaagaagcaggaaaatgtgaccccaaaacaggagaaaagccaggtaatagaaatagatttaaaaaaaaaaaacacccaaaacccccacaaaaaaagatgattgaatttgcagtcaaggatttttaagcagctattataaatatgttgagattaaaggataacttaaacataatgaggagataaatacaaaatacagaaaacaacaaaatggaatttctagagttgaaagatctgaaatgaagtgaaattaaatgaagaatcactgaatgggtttaacagcaaattagacactacagaaaacaagatcagtgaaattgaaga

SEQ ID NO: 5308 - DNA, 1194 bp, synthetic construct
  misc_feature 1..1194: note = Synthetic polypeptide
  source 1..1194: mol_type = other DNA
atgtggctgaagctttttttcttgctcctctatttcctggtcctgttcgtcctggccaggttttttgaggccattgtgtggtatgaaactggcatctttgccacccagctggtggatccggtggcgctgagcttcaagaagctgaagaccattttggagtgccgggggttgggctactcagggttgcccgagaagaaggatgtccgggagctggtggaaaagtcaggtgacttgatggagggtgagctctattctgctctcaaggaagaagaagcatccgaatcggtttctagtaccaatttcagtggtgaaatgcacttctatgagcttgtggaagacacaaaagatggcatctggctggttcaggtcaatgagtggtcattgaagataagaaaggaaatgagagttgttgacaggcaaataaggggatccattggagtctttggctgaatactaagctgtgcatgcttagagtgaaatttcaagagactgggcaaagaacaattactaggaacagaacaactaccaggaagctgtaagctgaataattcttagagctaataaaggattgagaagtggttgagctctgatcagacacagaaaagagactttgttgaacctctgggatgttcaatagagacctcagaagagtcacaccttaataataaggatcaggtaggtagtcctagaaaaaaggctaccacaagcccataccaaccaaccaacaagacttaaaagacttcacggctgatttgcaggtaatttgactgcctgccaaagtaaagattaacactgtttaagggaagactacaaaatgcaggcacccaacaatgaaacatatacagtggccagcatccaataagatactattatgaagaagcaggaaaatgtgaccccaaaacaggagaaaagccaggtaatagaaatagatttaaaaaaaaaaaacacccaaaacccccacaaaaaaagatgattgaatttgcagtcaaggatttttaagcagctattataaatatgttgagattaaaggataacttaaacataatgaggagataaatacaaaatacagaaaacaacaaaatggaatttctagagttgaaagatctgaaatgaagtgaaattaaatgaagaatcactgaatgggtttaacagcaaattagacactacagaaaacaagatcagtgaaattgaaga

SEQ ID NO: 5309 - DNA, 298 bp, synthetic construct
  misc_feature 1..298: note = Synthetic polypeptide
  source 1..298: mol_type = other DNA
atgcgcgcccgccgggggctgctgcggctgccgcgccgctcgctgctcgccgcgctcttcttcttttctctctcgtcctcgctgctgtacttcgtctatgtggcgcccggcatagtgaacacctacctcttcatgatgcaagcccaaggcattctgatccgggacaacgtgagaacaatcggtgctcaggtttatgagcaggtgcttcggagtgcttatgccaagaggaacagcagtgtaaatgactcagaaaggcagcacagagtacagaagggaggaatcatcaccgagagaatac

SEQ ID NO: 5310 - DNA, 645 bp, synthetic construct; identical to SEQ ID NO: 4051
  misc_feature 1..645: note = Synthetic polypeptide
  source 1..645: mol_type = other DNA

SEQ ID NO: 5311 - DNA, 506 bp, synthetic construct; identical to SEQ ID NO: 1096
  misc_feature 1..506: note = Synthetic polypeptide
  source 1..506: mol_type = other DNA

SEQ ID NO: 5312 - DNA, 1168 bp, synthetic construct; identical to SEQ ID NO: 1703
  misc_feature 1..1168: note = Synthetic polypeptide
  source 1..1168: mol_type = other DNA

SEQ ID NO: 5313 - DNA, 2721 bp, synthetic construct; identical to SEQ ID NO: 962
  misc_feature 1..2721: note = Synthetic polypeptide
  source 1..2721: mol_type = other DNA

SEQ ID NO: 5314 - DNA, 2549 bp, synthetic construct; identical to SEQ ID NO: 963
  misc_feature 1..2549: note = Synthetic polypeptide
  source 1..2549: mol_type = other DNA

SEQ ID NO: 5315 - DNA, 822 bp, synthetic construct; identical to SEQ ID NO: 119
  misc_feature 1..822: note = Synthetic polypeptide
  source 1..822: mol_type = other DNA

SEQ ID NO: 5316 - DNA, 2030 bp, synthetic construct; identical to SEQ ID NO: 1961
  misc_feature 1..2030: note = Synthetic polypeptide
  source 1..2030: mol_type = other DNA

SEQ ID NO: 5317 - DNA, 1847 bp, synthetic construct; identical to SEQ ID NO: 1962
  misc_feature 1..1847: note = Synthetic polypeptide
  source 1..1847: mol_type = other DNA

SEQ ID NO: 5318 - DNA, 1395 bp, synthetic construct; identical to SEQ ID NO: 1963
  misc_feature 1..1395: note = Synthetic polypeptide
  source 1..1395: mol_type = other DNA

SEQ ID NO: 5319 - DNA, 1398 bp, synthetic construct; identical to SEQ ID NO: 1964
  misc_feature 1..1398: note = Synthetic polypeptide
  source 1..1398: mol_type = other DNA

SEQ ID NO: 5320 - DNA, 569 bp, synthetic construct; identical to SEQ ID NO: 426
  misc_feature 1..569: note = Synthetic polypeptide
  source 1..569: mol_type = other DNA

SEQ ID NO: 5321 - DNA, 181 bp, synthetic construct
  misc_feature 1..181: note = Synthetic polypeptide
  source 1..181: mol_type = other DNA
atgctacccattatcttctaaatggccttcagaaatgatggagaaactgacacgttatgagtatttcctgccctacatggattttgaacttgaattcccagcctcgcttgcatctagacacaggcacgtgacccaagccccaccagtcagacaaacccaattgaaactttagttcaaaagc

SEQ ID NO: 5322 - DNA, 374 bp, synthetic construct
  misc_feature 1..374: note = Synthetic polypeptide
  source 1..374: mol_type = other DNA
atgtgtaaaatggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatatctacttgtctcattcccttaactacactcgaacttaagcatcagcttctccgtgaggccccctgaccatcctgtctccaataatatctctcctgggattggaccctcaccacccc

SEQ ID NO: 5323 - DNA, 464 bp, synthetic construct
  misc_feature 1..464: note = Synthetic polypeptide
  source 1..464: mol_type = other DNA
atggcacacgcaccggcacgctgccccagcgcccggggctccggggacggcgagatgggcaagcccaggaacgtggcgctcatcaccggtatcacaggccaggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatatctacttgtctcattcccttaactacactcgaacttaagcatcagcttctccgtgaggccccctgaccatcctgtctccaataatatctctcctgggattggaccctcaccacccc

SEQ ID NO: 5324 - DNA, 3992 bp, synthetic construct; identical to SEQ ID NO: 120
  misc_feature 1..3992: note = Synthetic polypeptide
  source 1..3992: mol_type = other DNA

SEQ ID NO: 5325 - DNA, 3845 bp, synthetic construct; identical to SEQ ID NO: 121
  misc_feature 1..3845: note = Synthetic polypeptide
  source 1..3845: mol_type = other DNA

SEQ ID NO: 5326 - DNA, 285 bp, synthetic construct; identical to SEQ ID NO: 4104
  misc_feature 1..285: note = Synthetic polypeptide
  source 1..285: mol_type = other DNA

SEQ ID NO: 5327 - DNA, 370 bp, synthetic construct; identical to SEQ ID NO: 4105
  misc_feature 1..370: note = Synthetic polypeptide
  source 1..370: mol_type = other DNA

SEQ ID NO: 5328 - DNA, 250 bp, synthetic construct; identical to SEQ ID NO: 4106
  misc_feature 1..250: note = Synthetic polypeptide
  source 1..250: mol_type = other DNA

SEQ ID NO: 5329 - DNA, 400 bp, synthetic construct; identical to SEQ ID NO: 4107
  misc_feature 1..400: note = Synthetic polypeptide
  source 1..400: mol_type = other DNA

SEQ ID NO: 5330 - DNA, 403 bp, synthetic construct; identical to SEQ ID NO: 4108
  misc_feature 1..403: note = Synthetic polypeptide
  source 1..403: mol_type = other DNA

SEQ ID NO: 5331 - DNA, 270 bp, synthetic construct
  misc_feature 1..270: note = Synthetic polypeptide
  source 1..270: mol_type = other DNA
atggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagtggtacccctagaggtttgctgtgac

SEQ ID NO: 5332 - DNA, 255 bp, synthetic construct
  misc_feature 1..255: note = Synthetic polypeptide
  source 1..255: mol_type = other DNA
atgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagtggtacccctagaggtttgctgtgac

SEQ ID NO: 5333 - DNA, 336 bp, synthetic construct
  misc_feature 1..336: note = Synthetic polypeptide
  source 1..336: mol_type = other DNA
gacgtgttcctcatgatccggcgccacaagaccaccatcttcacggacgccaaggagtccagcacggtgttcgaactgaagcgcatcgtcgagggcatcctcaagcggcctcctgacgagcagcggctgtacaagttgctggtcagaagtctttgggacttgccccatgtagggcctctcccaagatcctgcttctctcctcaggatgaccaactcttggatgatggcaagacactgggcgagtgtggcttcaccagtcaaacagcacggccacaggccccagccacagtggggctggccttccgggcagtggtacccctagaggtttgctgtgac

SEQ ID NO: 5334 - DNA, 646 bp, synthetic construct; identical to SEQ ID NO: 5010
  misc_feature 1..646: note = Synthetic polypeptide
  source 1..646: mol_type = other DNA

SEQ ID NO: 5335 - DNA, 47 bp, synthetic construct; identical to SEQ ID NO: 2014
  misc_feature 1..47: note = Synthetic polypeptide
  source 1..47: mol_type = other DNA

SEQ ID NO: 5336 - DNA, 662 bp, synthetic construct; identical to SEQ ID NO: 4372
  misc_feature 1..662: note = Synthetic polypeptide
  source 1..662: mol_type = other DNA

SEQ ID NO: 5337 - DNA, 281 bp, synthetic construct; identical to SEQ ID NO: 2021
  misc_feature 1..281: note = Synthetic polypeptide
  source 1..281: mol_type = other DNA

SEQ ID NO: 5338 - DNA, 248 bp, synthetic construct; identical to SEQ ID NO: 2022
  misc_feature 1..248: note = Synthetic polypeptide
  source 1..248: mol_type = other DNA

SEQ ID NO: 5339 - DNA, 1487 bp, synthetic construct; identical to SEQ ID NO: 2023
  misc_feature 1..1487: note = Synthetic polypeptide
  source 1..1487: mol_type = other DNA

SEQ ID NO: 5340 - DNA, 1538 bp, synthetic construct; identical to SEQ ID NO: 2024
  misc_feature 1..1538: note = Synthetic polypeptide
  source 1..1538: mol_type = other DNA

SEQ ID NO: 5341 - DNA, 1427 bp, synthetic construct; identical to SEQ ID NO: 2025
  misc_feature 1..1427: note = Synthetic polypeptide
  source 1..1427: mol_type = other DNA

SEQ ID NO: 5342 - DNA, 568 bp, synthetic construct; identical to SEQ ID NO: 1967
  misc_feature 1..568: note = Synthetic polypeptide
  source 1..568: mol_type = other DNA

SEQ ID NO: 5343 - DNA, 379 bp, synthetic construct; identical to SEQ ID NO: 1968
  misc_feature 1..379: note = Synthetic polypeptide
  source 1..379: mol_type = other DNA

SEQ ID NO: 5344 - DNA, 3308 bp, synthetic construct; identical to SEQ ID NO: 428
  misc_feature 1..3308: note = Synthetic polypeptide
  source 1..3308: mol_type = other DNA

SEQ ID NO: 5345 - DNA, 3203 bp, synthetic construct; identical to SEQ ID NO: 429
  misc_feature 1..3203: note = Synthetic polypeptide
  source 1..3203: mol_type = other DNA

SEQ ID NO: 5346 - DNA, 2849 bp, synthetic construct; identical to SEQ ID NO: 430
  misc_feature 1..2849: note = Synthetic polypeptide
  source 1..2849: mol_type = other DNA

SEQ ID NO: 5347 - DNA, 388 bp, synthetic construct; identical to SEQ ID NO: 431
  misc_feature 1..388: note = Synthetic polypeptide
  source 1..388: mol_type = other DNA

SEQ ID NO: 5348 - DNA, 335 bp, synthetic construct; identical to SEQ ID NO: 2120
  misc_feature 1..335: note = Synthetic polypeptide
  source 1..335: mol_type = other DNA

SEQ ID NO: 5349 - DNA, 128 bp, synthetic construct; identical to SEQ ID NO: 144
  misc_feature 1..128: note = Synthetic polypeptide
  source 1..128: mol_type = other DNA

SEQ ID NO: 5350 - DNA, 128 bp, synthetic construct; identical to SEQ ID NO: 1082
  misc_feature 1..128: note = Synthetic polypeptide
  source 1..128: mol_type = other DNA

SEQ ID NO: 5351 - DNA, 1563 bp, synthetic construct; identical to SEQ ID NO: 2008
  misc_feature 1..1563: note = Synthetic polypeptide
  source 1..1563: mol_type = other DNA

SEQ ID NO: 5352 - DNA, 3908 bp, synthetic construct
  misc_feature 1..3908: note = Synthetic polypeptide
  source 1..3908: mol_type = other DNA
atgaaaatacttgtggcatttctggtggtgctgaccatctttgggatacaatctcatggatacgaggtttttaacatcatcagcccaagcaacaatggtggcaatgttcaggagacagtgacaattgataatgaaaaaaataccgccatcattaacatccatgcaggatcatgctcttctaccacaatttttgactataaacatggctacattgcatccagggtgctctcccgaagagcctgctttatcctgaagatggaccatcagaacatccctcctctgaacaatctccaatggtacatctatgagaaacaggctctggacaacatgttctccagcaaatacacctgggtcaagtacaaccctctggagtctctgatcaaagacgtggattggttcctgcttgggtcacccattgagaaactctgcaaacatatccctttgtataagggggaagtggttgaaaacacacacctctgggatcctagctgcagaggacccccggcctccgcgtttgagctgacatgagactctcactagagattagatggagaaagggctccagcaggcacggagctggaagctttgtctgtgagacagctccgcgggagcactcatcccccagggctctctgtctccctctgagaggctctggccccatataaccaccagaatgggagaagaagtgcttccccgtgggattagggcacatctgtcccgcaggcccacctgcctgccagtccctcccaggattcctgcctggccaccccacaggagtgtgtacacagtgcagcctcagctgctcagcatgggtgctttgctccacttgagtgcattccggcagcgtgggagctgtttgaatcccccagtgcacacagatcccaaccccaagggtccaggggagggagctgtgagcagatccggacgtcccagggctgtggctccggagtgcggaactgggcccagtgcttcagcagaagaggagcccatactctcagaaaactctcagagaggggtgagtcgcacaggttcctgggctggtgtggaacctaggcgtgcctccctccacagagctggtccagtaagtgtggggcctgtctccctgctggacctctgcctgaaggagcccaacgacctggaacacctaacaacaacagaaagtcacggccacagtgccagtgatcaggggtccctcccctcaagaccgaggaggagacctggtgaggggtcacccctctcccccttgcaccacagagcacggcttcaaaggcccggatacacaaaggagccgggtggcagaatattagtctagctatctcccattgctctcacgcgccatctactggatttcatcccaaactacaacacgaaaaactgctaattttcctgcctgccaggccgaggactggaattcaacagactgtttagagcctttgccctctgaaaacttccagaaatgaagccaactgactatattcagtttacaccagagttaaaggaacgccaaccctcccagatgagaaagaatcagtgcaagaactgtagcaatttaaaaaaccagagcgtccccttacctccaaatgagcccactagctccacagcaattgttcttaaccaatctgaaatgatgagcatggaattcagaatctgaatggcaatgaagcttatagatatccaggagaaagttgaaatgcaatccaaggaaaccaagcaatccagtgaaatggtttaagagctgaaagataaaatagcaattttacaaaagacccaaactgagcttattgagttcaaaaaagaatttcataatacaatcagaagtattaatagcagaataggccaagctgaggaaagaatctcagagcttgacccctggttctttgaatcaacttagacaaaaataaagaaaaaagagttttaagaaatgaacacaatctcccagaaatatgagattatgtaaagagacaaaatctatgactcattgccatccctgagagagaaggagagagaataagcaacttggaaaatatatttggggacatagcccacaaaaatttccctaatctctctagagaggttgacatgtaaattcaagaaatacagaagaccttggccagataatatacaagatgaccatccccaaggcacatagtcatcagattcaccatggtcaatgcaaaagaaaaaaatcttaaagacagctagggagaagggtcaagtcacatgcagaaggactctcattaggctggcagtggacctctcagcagaaacctgacaagccagaagagatggagggagaggggtctatttttgtcatccttaaagaaaaaaaattccaaccaagagtctcatacactgccaaactaagcttcctaagtgaaggagaaataaaaaccttctcagacaagcaaatgctgaaggaattcaactagaccagcctaacaagaggtcctaagggagtgctgaatatggactcaaaagaataacacctgctaccacaaacactcacttaagcacacagcccaacgacactataggcaattacacagtaagtctacataacaacacaatgacaggatcaacatctcacacatcaatactaaccccgagtgtaaaggggctaaatgccccacttaaaagacatagagtgtcaagcttgataaaaagacaagatccaatcatccactattttcaagagctctatgttatgtgtaatgacacccacagactcaaagacttggagaaagatttatcatgcaaaatcagaaaacaaaaaagagcaggagtcactagttttatatcagacaaaacagactttaaacccttaataattaagaaagacaaagaagggtatttcctggaccacagaaggcttattggaaaaaaggacataatgacaaagggtacaatccaacaagaagttttaactattctaaatatatacacacccaacattggagcacccagatttataaaacaagtacttctcgatctacaagaagacttagacagccacacaataatagtgggagactttcacatcctacttacagatcattgagacagaaaactaataaaagaactctggacttaaacttgttacttgaccaattggacctaatagatatccacagaaaacttcacccaacaaagacagaatatacattcttcttatctgcacatggaacacattccaagatcaatcacatgctaggtaagaaagcaagtctcaataaattaaaaaaaattgaaatcatacgaaccttaatatcagaccacaatgtaattaaaaataaatcaatatcaagaagatctcatacataaatacatgaaaattaaacaacttactcctgaataactcttgtgtgaacatcaaaattcaggaagaaataaaaaattatttgaaattactaaaaatagagacataccttaccaaaatctctggggtacagctaaagcagtgttaagaggaaagtttatagcactaaatgccttaatcaagaagttaggaagatctcaaattagcagtctaactttgcatctaaaagaactagacagaaaagaacaaaccaaccccaaagctagcagaataaaagaagtcactaaagttagagaagaatggaatgaaattgagatgcaaaatccatacaaaagatcaaatgaaaccaatagttgtttctttgaaagaataaataaaattgatagacccacctagctagatgaacaaaaaagaaagatccaaataaacacaatcagaaatgacaaaggtgatgttacaattgatccacagaaatacttgtcctcagagactgctatgaacgtacacaaattagaaaatatagaggaaatggataaattcctgaaagcaaaaaatctcccaagattgaatagatgtgaaaattctcaacaaa

SEQ ID NO: 5353 - DNA, 212 bp, synthetic construct; identical to SEQ ID NO: 2100
  misc_feature 1..212: note = Synthetic polypeptide
  source 1..212: mol_type = other DNA

SEQ ID NO: 5354 - DNA, 509 bp, synthetic construct
  misc_feature 1..509: note = Synthetic polypeptide
  source 1..509: mol_type = other DNA
atggccccgcggcgggcgcgcggctgccggaccctcggtctcccggcgctgctactgctgctgctgctccggccgccggcgacgcgggatgcaagagacaggctggctgtcctggcgggaaggagcagaatatctgaaagcttcaaccatgaggtccagacacacgaggcctgcgtgagactcaggacaatggaaaactgcccccagtgccaccaccatcggacaagcaggcagcaagcaggtagcacagccatctatcatggagggcaggatggggtgggcaagtgtggagaaataacactctgtggtttaggcaggtagagaaggacagaagatcagtgtggagcagaacatggagaaaaagcctctgacactccagcaccagatagcaccagaggcctcaaagccagtggggctctgcaggtaaccatagcaacagcagcatccaaatccacctcaacaacttgtgagatcgactccatctctcacgccatcagcttagcagaaga

SEQ ID NO: 5355 - DNA, 258 bp, synthetic construct; identical to SEQ ID NO: 265
  misc_feature 1..258: note = Synthetic polypeptide
  source 1..258: mol_type = other DNA

SEQ ID NO: 5356 - DNA, 243 bp, synthetic construct; identical to SEQ ID NO: 267
  misc_feature 1..243: note = Synthetic polypeptide
  source 1..243: mol_type = other DNA

SEQ ID NO: 5357 - DNA, 324 bp, synthetic construct; identical to SEQ ID NO: 268
  misc_feature 1..324: note = Synthetic polypeptide
  source 1..324: mol_type = other DNA

SEQ ID NO: 5358 - DNA, 586 bp, synthetic construct; identical to SEQ ID NO: 401
  misc_feature 1..586: note = Synthetic polypeptide
  source 1..586: mol_type = other DNA

SEQ ID NO: 5359 - DNA, 829 bp, synthetic construct; identical to SEQ ID NO: 402
  misc_feature 1..829: note = Synthetic polypeptide
  source 1..829: mol_type = other DNA

SEQ ID NO: 5360 - DNA, 1060 bp, synthetic construct; identical to SEQ ID NO: 403
  misc_feature 1..1060: note = Synthetic polypeptide
  source 1..1060: mol_type = other DNA

SEQ ID NO: 5361 - DNA, 730 bp, synthetic construct; identical to SEQ ID NO: 406
  misc_feature 1..730: note = Synthetic polypeptide
  source 1..730: mol_type = other DNA

SEQ ID NO: 5362 - DNA, 496 bp, synthetic construct; identical to SEQ ID NO: 408
  misc_feature 1..496: note = Synthetic polypeptide
  source 1..496: mol_type = other DNA

SEQ ID NO: 5363 - DNA, 679 bp, synthetic construct; identical to SEQ ID NO: 1729
  misc_feature 1..679: note = Synthetic polypeptide
  source 1..679: mol_type = other DNA

SEQ ID NO: 5364 - DNA, 840 bp, synthetic construct; identical to SEQ ID NO: 1937
  misc_feature 1..840: note = Synthetic polypeptide
  source 1..840: mol_type = other DNA

SEQ ID NO: 5365 - DNA, 559 bp, synthetic construct; identical to SEQ ID NO: 1701
  misc_feature 1..559: note = Synthetic polypeptide
  source 1..559: mol_type = other DNA

SEQ ID NO: 5366 - DNA, 307 bp, synthetic construct; identical to SEQ ID NO: 2622
  misc_feature 1..307: note = Synthetic polypeptide
  source 1..307: mol_type = other DNA

SEQ ID NO: 5367 - DNA, 2154 bp, synthetic construct
  misc_feature 1..2154: note = Synthetic polypeptide
  source 1..2154: mol_type = other DNA
atggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgcaaggcccatcttttgcctacggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggcccaggacttcgaggctgcaatgagctataattgcatcattgcactccagcctgggcaacagagaccctgtctca

SEQ ID NO: 5368 - DNA, 2133 bp, synthetic construct
  misc_feature 1..2133: note = Synthetic polypeptide
  source 1..2133: mol_type = other DNA
atggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggcccaggacttcgaggctgcaatgagctataattgcatcattgcactccagcctgggcaacagagaccctgtctca

SEQ ID NO: 5369 - DNA, 163 bp, synthetic construct; identical to SEQ ID NO: 4202
  misc_feature 1..163: note = Synthetic polypeptide
  source 1..163: mol_type = other DNA

SEQ ID NO: 5370 - DNA, 1394 bp, synthetic construct; identical to SEQ ID NO: 1118
  misc_feature 1..1394: note = Synthetic polypeptide
  source 1..1394: mol_type = other DNA

SEQ ID NO: 5371 - DNA, 1625 bp, synthetic construct; identical to SEQ ID NO: 1119
  misc_feature 1..1625: note = Synthetic polypeptide
  source 1..1625: mol_type = other DNA

SEQ ID NO: 5372 - DNA, 1505 bp, synthetic construct; identical to SEQ ID NO: 1120
  misc_feature 1..1505: note = Synthetic polypeptide
  source 1..1505: mol_type = other DNA

SEQ ID NO: 5373 - DNA, 1562 bp, synthetic construct; identical to SEQ ID NO: 1121
  misc_feature 1..1562: note = Synthetic polypeptide
  source 1..1562: mol_type = other DNA

SEQ ID NO: 5374 - DNA, 1601 bp, synthetic construct; identical to SEQ ID NO: 1122
  misc_feature 1..1601: note = Synthetic polypeptide
  source 1..1601: mol_type = other DNA

SEQ ID NO: 5375 - DNA, 1631 bp, synthetic construct; identical to SEQ ID NO: 1123
  misc_feature 1..1631: note = Synthetic polypeptide
  source 1..1631: mol_type = other DNA

SEQ ID NO: 5376 - DNA, 938 bp, synthetic construct; identical to SEQ ID NO: 2101
  misc_feature 1..938: note = Synthetic polypeptide
  source 1..938: mol_type = other DNA

SEQ ID NO: 5377 - DNA, 55 bp, synthetic construct; identical to SEQ ID NO: 291
  misc_feature 1..55: note = Synthetic polypeptide
  source 1..55: mol_type = other DNA

SEQ ID NO: 5378 - DNA, 25 bp, synthetic construct
  misc_feature 1..25: note = Synthetic polypeptide
  source 1..25: mol_type = other DNA
atgagcgtcctttcgtttttttaaa

SEQ ID NO: 5379 - DNA, 341 bp, synthetic construct
  misc_feature 1..341: note = Synthetic polypeptide
  source 1..341: mol_type = other DNA
atggggccgccgctcccgctgctgctgctgctactgctgctgctgccgccacgcgtcctgcctgccgccccttcgtccgtcccccgcggccggcagctcccggggcgtctgggctgcctgctcgaggagggcctctgcggagcgtccgaggcctgtgtgaacgaaaccatggagaccagaagtgtgatgaacctcgcatgtgatggaagaaaacaccccatcaattcaagttctctactccctggaaatgtttctcaggtataaagatgaaatcaagacgtgaccagacagacagaacttgagagactccatcaacagatgactcttaggaaaagacagac

SEQ ID NO: 5380 - DNA, 410 bp, synthetic construct
  misc_feature 1..410: note = Synthetic polypeptide
  source 1..410: mol_type = other DNA
atggctgtggaatctgaatattcactgctgagaaccgaagccagctttcctactatgaagatgttctgtgtgagccacaccttgcccagggtggaagtgatgtttgtttcaggtccacagacgagggagaggacggagccagtggaccctcggtggcagtgtctggtgcagatgtgggcaggctgcctgctcgaggagggcctctgcggagcgtccgaggcctgtgtgaacgaaaccatggagaccagaagtgtgatgaacctcgcatgtgatggaagaaaacaccccatcaattcaagttctctactccctggaaatgtttctcaggtataaagatgaaatcaagacgtgaccagacagacagaacttgagagactccatcaacagatgactcttaggaaaagacagac

SEQ ID NO: 5381 - DNA, 304 bp, synthetic construct
  misc_feature 1..304: note = Synthetic polypeptide
  source 1..304: mol_type = other DNA
atggcagagaatcacgcccagaataaagccaagctcatctctgagacccggaggaggttcgaagctgagtatgtgacagggacatggatgaagctggaaaccatcattctgagcaaactatggcaaggacagaaaaccaaacaccgcatgttctcactcataggtgggaattgaacaatgagaacacttggacacagggtggggaacatcacacaccagggcctggcatggggtgggggaaggggggagggatagcattaggagatatacctaatgtaaatgacgagttaatgggtgcagcata

SEQ ID NO: 5382 - DNA, 1400 bp, synthetic construct; identical to SEQ ID NO: 2146
  misc_feature 1..1400: note = Synthetic polypeptide
  source 1..1400: mol_type = other DNA

SEQ ID NO: 5383 - DNA, 1403 bp, synthetic construct; identical to SEQ ID NO: 2147
  misc_feature 1..1403: note = Synthetic polypeptide
  source 1..1403: mol_type = other DNA

SEQ ID NO: 5384 - DNA, 1273 bp, synthetic construct; identical to SEQ ID NO: 2173
  misc_feature 1..1273: note = Synthetic polypeptide
  source 1..1273: mol_type = other DNA

SEQ ID NO: 5385 - DNA, 763 bp, synthetic construct; identical to SEQ ID NO: 261
  misc_feature 1..763: note = Synthetic polypeptide
  source 1..763: mol_type = other DNA

SEQ ID NO: 5386 - DNA, 646 bp, synthetic construct; identical to SEQ ID NO: 262
  misc_feature 1..646: note = Synthetic polypeptide
  source 1..646: mol_type = other DNA

SEQ ID NO: 5387 - DNA, 1166 bp, synthetic construct; identical to SEQ ID NO: 2201
  misc_feature 1..1166: note = Synthetic polypeptide
  source 1..1166: mol_type = other DNA

SEQ ID NO: 5388 - DNA, 1061 bp, synthetic construct; identical to SEQ ID NO: 2202
  misc_feature 1..1061: note = Synthetic polypeptide
  source 1..1061: mol_type = other DNA

SEQ ID NO: 5389 - DNA, 4191 bp, synthetic construct; identical to SEQ ID NO: 2054
  misc_feature 1..4191: note = Synthetic polypeptide
  source 1..4191: mol_type = other DNA

SEQ ID NO: 5390 - DNA, 24 bp, synthetic construct
  misc_feature 1..24: note = Synthetic polypeptide
  source 1..24: mol_type = other DNA
atggaagccttccctgactgccta

SEQ ID NO: 5391 - DNA, 1312 bp, synthetic construct; identical to SEQ ID NO: 4315
  misc_feature 1..1312: note = Synthetic polypeptide
  source 1..1312: mol_type = other DNA

SEQ ID NO: 5392 - DNA, 1069 bp, synthetic construct; identical to SEQ ID NO: 4316
  misc_feature 1..1069: note = Synthetic polypeptide
  source 1..1069: mol_type = other DNA

SEQ ID NO: 5393 - DNA, 1132 bp, synthetic construct; identical to SEQ ID NO: 4317
  misc_feature 1..1132: note = Synthetic polypeptide
  source 1..1132: mol_type = other DNA

SEQ ID NO: 5394 - DNA, 1181 bp, synthetic construct; identical to SEQ ID NO: 1730
  misc_feature 1..1181: note = Synthetic polypeptide
  source 1..1181: mol_type = other DNA

SEQ ID NO: 5395 - DNA, 983 bp, synthetic construct; identical to SEQ ID NO: 1731
  misc_feature 1..983: note = Synthetic polypeptide
  source 1..983: mol_type = other DNA

SEQ ID NO: 5396 - DNA, 1148 bp, synthetic construct; identical to SEQ ID NO: 1732
  misc_feature 1..1148: note = Synthetic polypeptide
  source 1..1148: mol_type = other DNA

SEQ ID NO: 5397 - DNA, 442 bp, synthetic construct; identical to SEQ ID NO: 1723
  misc_feature 1..442: note = Synthetic polypeptide
  source 1..442: mol_type = other DNA

SEQ ID NO: 5398 - DNA, 609 bp, synthetic construct; identical to SEQ ID NO: 249
  misc_feature 1..609: note = Synthetic polypeptide
  source 1..609: mol_type = other DNA

SEQ ID NO: 5399 - DNA, 738 bp, synthetic construct; identical to SEQ ID NO: 250
  misc_feature 1..738: note = Synthetic polypeptide
  source 1..738: mol_type = other DNA

SEQ ID NO: 5400 - DNA, 537 bp, synthetic construct; identical to SEQ ID NO: 251
  misc_feature 1..537: note = Synthetic polypeptide
  source 1..537: mol_type = other DNA

SEQ ID NO: 5401 - DNA, 684 bp, synthetic construct; identical to SEQ ID NO: 253
  misc_feature 1..684: note = Synthetic polypeptide
  source 1..684: mol_type = other DNA

SEQ ID NO: 5402 - DNA, 285 bp, synthetic construct; identical to SEQ ID NO: 255
  misc_feature 1..285: note = Synthetic polypeptide
  source 1..285: mol_type = other DNA

SEQ ID NO: 5403 - DNA, 552 bp, synthetic construct; identical to SEQ ID NO: 254
  misc_feature 1..552: note = Synthetic polypeptide
  source 1..552: mol_type = other DNA

SEQ ID NO: 5404 - DNA, 4277 bp, synthetic construct; identical to SEQ ID NO: 2069
  misc_feature 1..4277: note = Synthetic polypeptide
  source 1..4277: mol_type = other DNA

SEQ ID NO: 5405 - DNA, 572 bp, synthetic construct; identical to SEQ ID NO: 159
  misc_feature 1..572: note = Synthetic polypeptide
  source 1..572: mol_type = other DNA

SEQ ID NO: 5406 - DNA, 466 bp, synthetic construct; identical to SEQ ID NO: 2137
  misc_feature 1..466: note = Synthetic polypeptide
  source 1..466: mol_type = other DNA

SEQ ID NO: 5407 - DNA, 102 bp, synthetic construct; identical to SEQ ID NO: 258
  misc_feature 1..102: note = Synthetic polypeptide
  source 1..102: mol_type = other DNA

SEQ ID NO: 5408 - DNA, 82 bp, synthetic construct; identical to SEQ ID NO: 257
  misc_feature 1..82: note = Synthetic polypeptide
  source 1..82: mol_type = other DNA

SEQ ID NO: 5409 - DNA, 776 bp, synthetic construct
  misc_feature 1..776: note = Synthetic polypeptide
  source 1..776: mol_type = other DNA
atgaaaacgctccttcttttgctgctggtgctcctggagctgggagaggcccaaggatcccttcacagggtgcccctcaggaggcatccgtccctcaagaagaagctgcgggcacggagccagctctctgagttctggaaatcccataatttggacatgatccagttcaccgagtcctgctcaatggaccagagtgccaaggaacccctcatcaactacttggatatggaatacttcggcactatctccattggctccccaccacagaacttcactgtcatcttcgacactggctcctccaacctctgggtcccctctgtgtactgcactagcccagcctgcaagacgcacagcaggttccagccttcccagtccagcacatacagccagccaggtcaatctttctccattcagtatggaaccgggagcttgtccgggatcattggagccgaccaagtctctgttccagatcgcaatgtgaaaagtaaacaataaagcttttagaagaaaacatgagaaaatgttttcatgaccttaaggtaggcaaaattttctgaaacaagttacaaaaaaacagtgtacaataagcacatgatgagtgacagaagccagataccaaagagttcatatgggatgattccatttatataaaatccaaaaaataggcaaaaccaatatatgttattagaagtcaggagactggctcttcttgaggaggggcgcaatgattggcaggtgcatgagggcttctgaggtttggaatgtcctgttttttg

SEQ ID NO: 5410 - DNA, 551 bp, synthetic construct
  misc_feature 1..551: note = Synthetic polypeptide
  source 1..551: mol_type = other DNA
atggaatacttcggcactatctccattggctccccaccacagaacttcactgtcatcttcgacactggctcctccaacctctgggtcccctctgtgtactgcactagcccagcctgcaagacgcacagcaggttccagccttcccagtccagcacatacagccagccaggtcaatctttctccattcagtatggaaccgggagcttgtccgggatcattggagccgaccaagtctctgttccagatcgcaatgtgaaaagtaaacaataaagcttttagaagaaaacatgagaaaatgttttcatgaccttaaggtaggcaaaattttctgaaacaagttacaaaaaaacagtgtacaataagcacatgatgagtgacagaagccagataccaaagagttcatatgggatgattccatttatataaaatccaaaaaataggcaaaaccaatatatgttattagaagtcaggagactggctcttcttgaggaggggcgcaatgattggcaggtgcatgagggcttctgaggtttggaatgtcctgttttttg

SEQ ID NO: 5411 - DNA, 104 bp, synthetic construct
  misc_feature 1..104: note = Synthetic polypeptide
  source 1..104: mol_type = other DNA
atggccccgcgcgcccggcggcgccgcccgctgttcgcgctgctgctgctctgcgcgctgctcgcccggctgcaggtgattctgcgcacattggagaagcactg

SEQ ID NO: 5412 - DNA, 1412 bp, synthetic construct; identical to SEQ ID NO: 2038
  misc_feature 1..1412: note = Synthetic polypeptide
  source 1..1412: mol_type = other DNA

SEQ ID NO: 5413 - DNA, 2713 bp, synthetic construct; identical to SEQ ID NO: 1273
  misc_feature 1..2713: note = Synthetic polypeptide
  source 1..2713: mol_type = other DNA

SEQ ID NO: 5414 - DNA, 228 bp, synthetic construct; identical to SEQ ID NO: 1274
  misc_feature 1..228: note = Synthetic polypeptide
  source 1..228: mol_type = other DNA

SEQ ID NO: 5415 - DNA, 1372 bp, synthetic construct; identical to SEQ ID NO: 1756
  misc_feature 1..1372: note = Synthetic polypeptide
  source 1..1372: mol_type = other DNA

SEQ ID NO: 5416 - DNA, 1032 bp, synthetic construct; identical to SEQ ID NO: 1790
  misc_feature 1..1032: note = Synthetic polypeptide
  source 1..1032: mol_type = other DNA

SEQ ID NO: 5417 - DNA, 289 bp, synthetic construct; identical to SEQ ID NO: 1791
  misc_feature 1..289: note = Synthetic polypeptide
  source 1..289: mol_type = other DNA

SEQ ID NO: 5418 - DNA, 1314 bp, synthetic construct; identical to SEQ ID NO: 1792
  misc_feature 1..1314: note = Synthetic polypeptide
  source 1..1314: mol_type = other DNA

SEQ ID NO: 5419 - DNA, 620 bp, synthetic construct; identical to SEQ ID NO: 1793
  misc_feature 1..620: note = Synthetic polypeptide
  source 1..620: mol_type = other DNA

SEQ ID NO: 5420 - DNA, 1313 bp, synthetic construct
  misc_feature 1..1313: note = Synthetic polypeptide
  source 1..1313: mol_type = other DNA
atggtgttcgcattttggaaggtctttctgatcctaagctgccttgcaggtcaggttagtgtggtgcaagtgaccatcccagacggtttcgtgaacgtgactgttggatctaatgtcactctcatctgcatctacaccaccactgtggcctcccgagaacagctttccatccagtggtctttcttccataagaaggagatggagccaatttctcacagctcgtgcctcagtactgagggtatggaggaaaaggcagtcagtcagtgtctaaaaatgacgcacgcaagagacgctcggggaagatgtagctggacctctgagatttacttttctcaaggtggacaagctgtagccatcgggcaatttaaagatcgaattacagggtccaacgatccaggtaatgcatctatcactatctcgcatatgcagccagcagacagtggaatttacatctgcgatgttaacaaccccccagactttctcggccaaaaccaaggcatcctcaacgtcagtgtgttagtgaaaccttctaagcccctttgtagcgttcaaggaagaccagaaactggccacactatttccctttcctgtctctctgcgcttggaacaccttcccctgtgtactactggcataaacttgagggaagagacatcgtgccagtgaaagaaaacttcaacccaaccaccgggattttggtcattggaaatctgacaaattttgaacaaggttattaccagtgtactgccatcaacagacttggcaatagttcctgcgaaatcgatctcacttcttcacatccagaagttggaatcattgttggggccttgattggtagcctggtaggtgccgccatcatcatctctgttgtgtgcttcgcaaggaataaggcaaaagcaaaggcaaaagaaagaaattctaagaccatcgcggaacttgagccaatgacaaagataaacccaaggggagaaagcgaagcaatgccaagagaagacgctacccaactagaagtaactctaccatcttccattcatgagactggccctgataccatccaagaaccagactatgagccaaagcctactcaggagcctgccccagagcctgccccaggatcagagcctatggcagtgcctgaccttgacatcgagctggagctggagccagaaacgcagtcggaattggagccagagccagagccagagccagagtcagagcctggggttgcagtgagccgagattgtgccactgcactccaacctgggtgacagagtgagattccatctgaaaaacaaaaacaaaaacagaaaacaaa

SEQ ID NO: 5421 - DNA, 1205 bp, synthetic construct
  misc_feature 1..1205: note = Synthetic polypeptide
  source 1..1205: mol_type = other DNA
atggtgttcgcattttggaaggtctttctgatcctaagctgccttgcaggtcaggttagtgtggtgcaagtgaccatcccagacggtttcgtgaacgtgactgttggatctaatgtcactctcatctgcatctacaccaccactgtggcctcccgagaacagctttccatccagtggtctttcttccataagaaggagatggagccaatttctatttacttttctcaaggtggacaagctgtagccatcgggcaatttaaagatcgaattacagggtccaacgatccaggtaatgcatctatcactatctcgcatatgcagccagcagacagtggaatttacatctgcgatgttaacaaccccccagactttctcggccaaaaccaaggcatcctcaacgtcagtgtgttagtgaaaccttctaagcccctttgtagcgttcaaggaagaccagaaactggccacactatttccctttcctgtctctctgcgcttggaacaccttcccctgtgtactactggcataaacttgagggaagagacatcgtgccagtgaaagaaaacttcaacccaaccaccgggattttggtcattggaaatctgacaaattttgaacaaggttattaccagtgtactgccatcaacagacttggcaatagttcctgcgaaatcgatctcacttcttcacatccagaagttggaatcattgttggggccttgattggtagcctggtaggtgccgccatcatcatctctgttgtgtgcttcgcaaggaataaggcaaaagcaaaggcaaaagaaagaaattctaagaccatcgcggaacttgagccaatgacaaagataaacccaaggggagaaagcgaagcaatgccaagagaagacgctacccaactagaagtaactctaccatcttccattcatgagactggccctgataccatccaagaaccagactatgagccaaagcctactcaggagcctgccccagagcctgccccaggatcagagcctatggcagtgcctgaccttgacatcgagctggagctggagccagaaacgcagtcggaattggagccagagccagagccagagccagagtcagagcctggggttgcagtgagccgagattgtgccactgcactccaacctgggtgacagagtgagattccatctgaaaaacaaaaacaaaaacagaaaacaaa

SEQ ID NO: 5422 - DNA, 1143 bp, synthetic construct
  misc_feature 1..1143: note = Synthetic polypeptide
  source 1..1143: mol_type = other DNA
atgttctccaacgcaaacagcaggtccaaaatgtggctgcttttaacaatggcaagtttgatatctgtactggggactacacatggtttgtttggaaaattacatcctggaagccctgaagtgactatgaacattagtcagatgattacttattggggatacccaaatgaagaatatgaagttgtgactgaagatggttatattcttgaagtcaatagaattccttatgggaagaaaaattcagggaatacaggccagagacctgttgtgtttttgcagcatggtttgcttgcatcagccacaaactggatttccaacctgccgaacaacagccttgccttcattctggcagatgctggttatgatgtgtggctgggcaacagcagaggaaacacctgggccagaagaaacttgtactattcaccagattcagttgaattctgggctttcagctttgatgaaatggctaaatatgaccttccagccacaatcgacttcattgtaaagaaaactggacagaagcagctacactatgttggccattcccagggcaccaccattggttttattgccttttccaccaatcccagcctggctaaaagaatcaaaaccttctatgctctagctcctgttgccactgtgaagtatacaaaaagccttataaacaaacttagatttgttcctcaatccctcttcaagtttatatttggtgacaaaatattctacccacacaacttctttgatcaatttcttgctactgaagtgtgctcccgtgagatgctgaatctcctttgcagcaatgccttatttataatttgtggatttgacagtaagaactttaacacgagtcgcttggatgtgtatctatcacataatccagcaggaacttctgttcaaaacatgttccattggacccaggctgttaagtctgggaaattccaagcttatgactggggaagcccagttcagaataggatgcactatgatcagccttgctattcagagcatggtttggagccaatggcatcagcatcacctatgaatgcagaatctcaggctgttccccagatctactgaaacagaatttttacttcaacaagatcttcaggtaattcacaggcccattagaatttgacaagcact

SEQ ID NO: 5423 - DNA, 1014 bp, synthetic construct
  misc_feature 1..1014: note = Synthetic polypeptide
  source 1..1014: mol_type = other DNA
atgtggctgcttttaacaatggcaagtttgatatctgtactggggactacacatggtttgtttggaaaattacatcctggaagccctgaagtgactatgaacattagtcagatgattacttattggggatacccaaatgaagaatatgaagttgtgactgaagatggttatattcttgaagtcaatagaattccttatgggaagaaaaattcagggaatacagatgctggttatgatgtgtggctgggcaacagcagaggaaacacctgggccagaagaaacttgtactattcaccagattcagttgaattctgggctttcagctttgatgaaatggctaaatatgaccttccagccacaatcgacttcattgtaaagaaaactggacagaagcagctacactatgttggccattcccagggcaccaccattggttttattgccttttccaccaatcccagcctggctaaaagaatcaaaaccttctatgctctagctcctgttgccactgtgaagtatacaaaaagccttataaacaaacttagatttgttcctcaatccctcttcaagtttatatttggtgacaaaatattctacccacacaacttctttgatcaatttcttgctactgaagtgtgctcccgtgagatgctgaatctcctttgcagcaatgccttatttataatttgtggatttgacagtaagaactttaacacgagtcgcttggatgtgtatctatcacataatccagcaggaacttctgttcaaaacatgttccattggacccaggctgttaagtctgggaaattccaagcttatgactggggaagcccagttcagaataggatgcactatgatcagccttgctattcagagcatggtttggagccaatggcatcagcatcacctatgaatgcagaatctcaggctgttccccagatctactgaaacagaatttttacttcaacaagatcttcaggtaattcacaggcccattagaatttgacaagcact

SEQ ID NO: 5424 - DNA, 1113 bp, synthetic construct
  misc_feature 1..1113: note = Synthetic polypeptide
  source 1..1113: mol_type = other DNA
atgtggctgcttttaacaatggcaagtttgatatctgtactggggactacacatggtttgtttggaaaattacatcctggaagccctgaagtgactatgaacattagtcagatgattacttattggggatacccaaatgaagaatatgaagttgtgactgaagatggttatattcttgaagtcaatagaattccttatgggaagaaaaattcagggaatacaggccagagacctgttgtgtttttgcagcatggtttgcttgcatcagccacaaactggatttccaacctgccgaacaacagccttgccttcattctggcagatgctggttatgatgtgtggctgggcaacagcagaggaaacacctgggccagaagaaacttgtactattcaccagattcagttgaattctgggctttcagctttgatgaaatggctaaatatgaccttccagccacaatcgacttcattgtaaagaaaactggacagaagcagctacactatgttggccattcccagggcaccaccattggttttattgccttttccaccaatcccagcctggctaaaagaatcaaaaccttctatgctctagctcctgttgccactgtgaagtatacaaaaagccttataaacaaacttagatttgttcctcaatccctcttcaagtttatatttggtgacaaaatattctacccacacaacttctttgatcaatttcttgctactgaagtgtgctcccgtgagatgctgaatctcctttgcagcaatgccttatttataatttgtggatttgacagtaagaactttaacacgagtcgcttggatgtgtatctatcacataatccagcaggaacttctgttcaaaacatgttccattggacccaggctgttaagtctgggaaattccaagcttatgactggggaagcccagttcagaataggatgcactatgatcagccttgctattcagagcatggtttggagccaatggcatcagcatcacctatgaatgcagaatctcaggctgttccccagatctactgaaacagaatttttacttcaacaagatcttcaggtaattcacaggcccattagaatttgacaagcact

SEQ ID NO: 5425 - DNA, 1044 bp, synthetic construct
  misc_feature 1..1044: note = Synthetic polypeptide
  source 1..1044: mol_type = other DNA
atgttctccaacgcaaacagcaggtccaaaatgtggctgcttttaacaatggcaagtttgatatctgtactggggactacacatggtttgtttggaaaattacatcctggaagccctgaagtgactatgaacattagtcagatgattacttattggggatacccaaatgaagaatatgaagttgtgactgaagatggttatattcttgaagtcaatagaattccttatgggaagaaaaattcagggaatacagatgctggttatgatgtgtggctgggcaacagcagaggaaacacctgggccagaagaaacttgtactattcaccagattcagttgaattctgggctttcagctttgatgaaatggctaaatatgaccttccagccacaatcgacttcattgtaaagaaaactggacagaagcagctacactatgttggccattcccagggcaccaccattggttttattgccttttccaccaatcccagcctggctaaaagaatcaaaaccttctatgctctagctcctgttgccactgtgaagtatacaaaaagccttataaacaaacttagatttgttcctcaatccctcttcaagtttatatttggtgacaaaatattctacccacacaacttctttgatcaatttcttgctactgaagtgtgctcccgtgagatgctgaatctcctttgcagcaatgccttatttataatttgtggatttgacagtaagaactttaacacgagtcgcttggatgtgtatctatcacataatccagcaggaacttctgttcaaaacatgttccattggacccaggctgttaagtctgggaaattccaagcttatgactggggaagcccagttcagaataggatgcactatgatcagccttgctattcagagcatggtttggagccaatggcatcagcatcacctatgaatgcagaatctcaggctgttccccagatctactgaaacagaatttttacttcaacaagatcttcaggtaattcacaggcccattagaatttgacaagcact

SEQ ID NO: 5426 - DNA, 1041 bp, synthetic construct; identical to SEQ ID NO: 2160
  misc_feature 1..1041: note = Synthetic polypeptide
  source 1..1041: mol_type = other DNA

SEQ ID NO: 5427 - DNA, 987 bp, synthetic construct; identical to SEQ ID NO: 2161
  misc_feature 1..987: note = Synthetic polypeptide
  source 1..987: mol_type = other DNA

SEQ ID NO: 5428 - DNA, 1089 bp, synthetic construct; identical to SEQ ID NO: 2162
  misc_feature 1..1089: note = Synthetic polypeptide
  source 1..1089: mol_type = other DNA

SEQ ID NO: 5429 - DNA, 678 bp, synthetic construct; identical to SEQ ID NO: 2163
  misc_feature 1..678: note = Synthetic polypeptide
  source 1..678: mol_type = other DNA

SEQ ID NO: 5430 - DNA, 299 bp, synthetic construct; identical to SEQ ID NO: 1033
  misc_feature 1..299: note = Synthetic polypeptide
  source 1..299: mol_type = other DNA

SEQ ID NO: 5431 - DNA, 191 bp, synthetic construct; identical to SEQ ID NO: 1034
  misc_feature 1..191: note = Synthetic polypeptide
  source 1..191: mol_type = other DNA

SEQ ID NO: 5432 - DNA, 644 bp, synthetic construct; identical to SEQ ID NO: 2138
  misc_feature 1..644: note = Synthetic polypeptide
  source 1..644: mol_type = other DNA

SEQ ID NO: 5433 - DNA, 255 bp, synthetic construct; identical to SEQ ID NO: 2139
  misc_feature 1..255: note = Synthetic polypeptide
  source 1..255: mol_type = other DNA

SEQ ID NO: 5434 - DNA, 3723 bp, synthetic construct; identical to SEQ ID NO: 1743
  misc_feature 1..3723: note = Synthetic polypeptide
  source 1..3723: mol_type = other DNA

SEQ ID NO: 5435 - DNA, 3708 bp, synthetic construct; identical to SEQ ID NO: 1744
  misc_feature 1..3708: note = Synthetic polypeptide
  source 1..3708: mol_type = other DNA

SEQ ID NO: 5436 - DNA, 3333 bp, synthetic construct; identical to SEQ ID NO: 1745
  misc_feature 1..3333: note = Synthetic polypeptide
  source 1..3333: mol_type = other DNA

SEQ ID NO: 5437 - DNA, 193 bp, synthetic construct; identical to SEQ ID NO: 1992
  misc_feature 1..193: note = Synthetic polypeptide
  source 1..193: mol_type = other DNA

SEQ ID NO: 5438 - DNA, 312 bp, synthetic construct; identical to SEQ ID NO: 1728
  misc_feature 1..312: note = Synthetic polypeptide
  source 1..312: mol_type = other DNA

SEQ ID NO: 5439 - DNA, 520 bp, synthetic construct; identical to SEQ ID NO: 1727
  misc_feature 1..520: note = Synthetic polypeptide
  source 1..520: mol_type = other DNA

SEQ ID NO: 5440 - DNA, 690 bp, synthetic construct; identical to SEQ ID NO: 145
  misc_feature 1..690: note = Synthetic polypeptide
  source 1..690: mol_type = other DNA

SEQ ID NO: 5441 - DNA, 516 bp, synthetic construct; identical to SEQ ID NO: 5236
  misc_feature 1..516: note = Synthetic polypeptide
  source 1..516: mol_type = other DNA

SEQ ID NO: 5442 - DNA, 2731 bp, synthetic construct
  misc_feature 1..2731: note = Synthetic polypeptide
  source 1..2731: mol_type = other DNA
atggggtggcgggcggcgggcgcgctgctgctggcgctgctgctgcacgggcggctgctggcggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagttccgagaggtgtccgaggctgtggtagacacgctggagtcggagtacttgaaaattcccggagaccaggttgtcagtgtggtgttcatcaaggagctggatggctgggtttttgtggagctggatgtgggctcggaagggaatgcggatggggctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccacccccatcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcatgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggccagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcaattgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaaggcaacaagactgaaactccgtctcaaaaaaaaaaaaaaaaaaagaa

SEQ ID NO: 5443 - DNA, 3881 bp, synthetic construct; identical to SEQ ID NO: 1162
  misc_feature 1..3881: note = Synthetic polypeptide
  source 1..3881: mol_type = other DNA

SEQ ID NO: 5444 - DNA, 3722 bp, synthetic construct; identical to SEQ ID NO: 1163
  misc_feature 1..3722: note = Synthetic polypeptide
  source 1..3722: mol_type = other DNA

SEQ ID NO: 5445 - DNA, 410 bp, synthetic construct; identical to SEQ ID NO: 2072
  misc_feature 1..410: note = Synthetic polypeptide
  source 1..410: mol_type = other DNA

SEQ ID NO: 5446 - DNA, 188 bp, synthetic construct; identical to SEQ ID NO: 2073
  misc_feature 1..188: note = Synthetic polypeptide
  source 1..188: mol_type = other DNA

SEQ ID NO: 5447 - DNA, 1091 bp, synthetic construct; identical to SEQ ID NO: 2032
  misc_feature 1..1091: note = Synthetic polypeptide
  source 1..1091: mol_type = other DNA

SEQ ID NO: 5448 - DNA, 728 bp, synthetic construct; identical to SEQ ID NO: 269
  misc_feature 1..728: note = Synthetic polypeptide
  source 1..728: mol_type = other DNA

SEQ ID NO: 5449 - DNA, 663 bp, synthetic construct; identical to SEQ ID NO: 271
  misc_feature 1..663: note = Synthetic polypeptide
  source 1..663: mol_type = other DNA

SEQ ID NO: 5450 - DNA, 1052 bp, synthetic construct; identical to SEQ ID NO: 247
  misc_feature 1..1052: note = Synthetic polypeptide
  source 1..1052: mol_type = other DNA

SEQ ID NO: 5451 - DNA, 327 bp, synthetic construct; identical to SEQ ID NO: 246
  misc_feature 1..327: note = Synthetic polypeptide
  source 1..327: mol_type = other DNA

SEQ ID NO: 5452 - DNA, 92 bp, synthetic construct; identical to SEQ ID NO: 1765
  misc_feature 1..92: note = Synthetic polypeptide
  source 1..92: mol_type = other DNA

SEQ ID NO: 5453 - DNA, 169 bp, synthetic construct; identical to SEQ ID NO: 4125
  misc_feature 1..169: note = Synthetic polypeptide
  source 1..169: mol_type = other DNA

SEQ ID NO: 5454 - DNA, 2161 bp, synthetic construct; identical to SEQ ID NO: 288
  misc_feature 1..2161: note = Synthetic polypeptide
  source 1..2161: mol_type = other DNA

SEQ ID NO: 5455 - DNA, 2140 bp, synthetic construct; identical to SEQ ID NO: 289
  misc_feature 1..2140: note = Synthetic polypeptide
  source 1..2140: mol_type = other DNA

SEQ ID NO: 5456 - DNA, 529 bp, synthetic construct; identical to SEQ ID NO: 287
  misc_feature 1..529: note = Synthetic polypeptide
  source 1..529: mol_type = other DNA

SEQ ID NO: 5457 - DNA, 47 bp, synthetic construct; identical to SEQ ID NO: 2074
  misc_feature 1..47: note = Synthetic polypeptide
  source 1..47: mol_type = other DNA

SEQ ID NO: 5458 - DNA, 775 bp, synthetic construct; identical to SEQ ID NO: 215
  misc_feature 1..775: note = Synthetic polypeptide
  source 1..775: mol_type = other DNA

SEQ ID NO: 5459 - DNA, 1396 bp, synthetic construct
  misc_feature 1..1396: note = Synthetic polypeptide
  source 1..1396: mol_type = other DNA
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggagaatcgcttgaacccgggaggtggagattgcagtgagcccagatcgcaccactgcactccagtctggcaacagagcaagactccatctcaaaaagaaaagaaaagaa

SEQ ID NO: 5460 - DNA, 1399 bp, synthetic construct
  misc_feature 1..1399: note = Synthetic polypeptide
  source 1..1399: mol_type = other DNA
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggagaatcgcttgaacccgggaggtggagattgcagtgagcccagatcgcaccactgcactccagtctggcaacagagcaagactccatctcaaaaagaaaagaaaagaa

SEQ ID NO: 5461 - DNA, 2849 bp, synthetic construct; identical to SEQ ID NO: 1326
  misc_feature 1..2849: note = Synthetic polypeptide
  source 1..2849: mol_type = other DNA

SEQ ID NO: 5462 - DNA, 1925 bp, synthetic construct; identical to SEQ ID NO: 1327
  misc_feature 1..1925: note = Synthetic polypeptide
  source 1..1925: mol_type = other DNA

SEQ ID NO: 5463 - DNA, 2729 bp, synthetic construct; identical to SEQ ID NO: 1328
  misc_feature 1..2729: note = Synthetic polypeptide
  source 1..2729: mol_type = other DNA

SEQ ID NO: 5464 - DNA, 2549 bp, synthetic construct; identical to SEQ ID NO: 1329
  misc_feature 1..2549: note = Synthetic polypeptide
  source 1..2549: mol_type = other DNA

SEQ ID NO: 5465 - DNA, 366 bp, synthetic construct; identical to SEQ ID NO: 1772
  misc_feature 1..366: note = Synthetic polypeptide
  source 1..366: mol_type = other DNA

SEQ ID NO: 5466 - DNA, 479 bp, synthetic construct; identical to SEQ ID NO: 4381
  misc_feature 1..479: note = Synthetic polypeptide
  source 1..479: mol_type = other DNA

SEQ ID NO: 5467 - DNA, 4120 bp, synthetic construct; identical to SEQ ID NO: 1356
  misc_feature 1..4120: note = Synthetic polypeptide
  source 1..4120: mol_type = other DNA

SEQ ID NO: 5468 - DNA, 4132 bp, synthetic construct; identical to SEQ ID NO: 1357
  misc_feature 1..4132: note = Synthetic polypeptide
  source 1..4132: mol_type = other DNA

SEQ ID NO: 5469 - DNA, 4120 bp, synthetic construct; identical to SEQ ID NO: 1358
  misc_feature 1..4120: note = Synthetic polypeptide
  source 1..4120: mol_type = other DNA

SEQ ID NO: 5470 - DNA, 4024 bp, synthetic construct; identical to SEQ ID NO: 1359
  misc_feature 1..4024: note = Synthetic polypeptide
  source 1..4024: mol_type = other DNA

SEQ ID NO: 5471 - DNA, 4531 bp, synthetic construct; identical to SEQ ID NO: 1360
  misc_feature 1..4531: note = Synthetic polypeptide
  source 1..4531: mol_type = other DNA

SEQ ID NO: 5472 - DNA, 4054 bp, synthetic construct; identical to SEQ ID NO: 1361
  misc_feature 1..4054: note = Synthetic polypeptide
  source 1..4054: mol_type = other DNA

SEQ ID NO: 5473 - DNA, 4078 bp, synthetic construct; identical to SEQ ID NO: 1362
  misc_feature 1..4078: note = Synthetic polypeptide
  source 1..4078: mol_type = other DNA

SEQ ID NO: 5474 - DNA, 4201 bp, synthetic construct; identical to SEQ ID NO: 1363
  misc_feature 1..4201: note = Synthetic polypeptide
  source 1..4201: mol_type = other DNA

SEQ ID NO: 5475 - DNA, 4189 bp, synthetic construct; identical to SEQ ID NO: 1364
  misc_feature 1..4189: note = Synthetic polypeptide
  source 1..4189: mol_type = other DNA

SEQ ID NO: 5476 - DNA, 210 bp, synthetic construct; identical to SEQ ID NO: 1365
  misc_feature 1..210: note = Synthetic polypeptide
  source 1..210: mol_type = other DNA

SEQ ID NO: 5477 - DNA, 329 bp, synthetic construct
  misc_feature 1..329: note = Synthetic polypeptide
  source 1..329: mol_type = other DNA
atggcccagccggtccacagcctctgctccgcctttggcctccagtgctgcctcctcttccttctagcttcttggggggcaggaggctgagatgagaggatcactgaagaccagagtttgagaccagcctggccaacatagtgagaccctgcgtcttaaaaaaaaaaaaaaaaaaaaggtgaggagggggcatactggctcacatttgtagtcccagctgacagggaggctgaggtgggggtactgcttgagcccaggaggtcaggactgcagtgagctgtgaccatgccactgcactccagcctggtgcagagtaagactctatctca

SEQ ID NO: 5478 - DNA, 3220 bp, synthetic construct; identical to SEQ ID NO: 248
  misc_feature 1..3220: note = Synthetic polypeptide
  source 1..3220: mol_type = other DNA

SEQ ID NO: 5479 - DNA, 671 bp, synthetic construct; identical to SEQ ID NO: 4064
  misc_feature 1..671: note = Synthetic polypeptide
  source 1..671: mol_type = other DNA

SEQ ID NO: 5480 - DNA, 186 bp, synthetic construct; identical to SEQ ID NO: 2172
  misc_feature 1..186: note = Synthetic polypeptide
  source 1..186: mol_type = other DNA

SEQ ID NO: 5481 - DNA, 528 bp, synthetic construct
  misc_feature 1..528: note = Synthetic polypeptide
  source 1..528: mol_type = other DNA
gcctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggatcacttgacctcaggagttggagaccagcctgggcaacatggtgaaaccccatctctattttattaaaaaagaaaagaaagagaaaaa

SEQ ID NO: 5482 - DNA, 372 bp, synthetic construct; identical to SEQ ID NO: 1188
  misc_feature 1..372: note = Synthetic polypeptide
  source 1..372: mol_type = other DNA

SEQ ID NO: 5483 - DNA, 1629 bp, synthetic construct; identical to SEQ ID NO: 2518
  misc_feature 1..1629: note = Synthetic polypeptide
  source 1..1629: mol_type = other DNA

SEQ ID NO: 5484 - DNA, 843 bp, synthetic construct; identical to SEQ ID NO: 2205
  misc_feature 1..843: note = Synthetic polypeptide
  source 1..843: mol_type = other DNA

SEQ ID NO: 5485 - DNA, 2153 bp, synthetic construct; identical to SEQ ID NO: 217
  misc_feature 1..2153: note = Synthetic polypeptide
  source 1..2153: mol_type = other DNA

SEQ ID NO: 5486 - DNA, 1664 bp, synthetic construct; identical to SEQ ID NO: 222
  misc_feature 1..1664: note = Synthetic polypeptide
  source 1..1664: mol_type = other DNA

SEQ ID NO: 5487 - DNA, 1766 bp, synthetic construct; identical to SEQ ID NO: 221
  misc_feature 1..1766: note = Synthetic polypeptide
  source 1..1766: mol_type = other DNA

SEQ ID NO: 5488 - DNA, 1130 bp, synthetic construct
  misc_feature 1..1130: note = Synthetic polypeptide
  source 1..1130: mol_type = other DNA
atgttctccaacgcaaacagcaggtccaaaatgtggctgcttttaacaatggcaagtttgatatctgtactggggactacacatggtttgtttggaaaattacatcctggaagccctgaagtgactatgaacattagtcagatgattacttattggggatacccaaatgaagaatatgaagttgtgactgaagatggttatattcttgaagtcaatagaattccttatgggaagaaaaattcagggaatacaggccagagacctgttgtgtttttgcagcatggtttgcttgcatcagccacaaactggatttccaacctgccgaacaacagccttgccttcattctggcagatgctggttatgatgtgtggctgggcaacagcagaggaaacacctgggccagaagaaacttgtactattcaccagattcagttgaattctgggctttcagctttgatgaaatggctaaatatgaccttccagccacaatcgacttcattgtaaagaaaactggacagaagcagctacactatgttggccattcccagggcaccaccattggttttattgccttttccaccaatcccagcctggctaaaagaatcaaaaccttctatgctctagctcctgttgccactgtgaagtatacaaaaagccttataaacaaacttagatttgttcctcaatccctcttcaagtttatatttggtgacaaaatattctacccacacaacttctttgatcaatttcttgctactgaagtgtgctcccgtgagatgctgaatctcctttgcagcaatgccttatttataatttgtggatttgacagtaagaactttaacacgagtcgcttggatgtgtatctatcacataatccagcaggaacttctgttcaaaacatgttccattggacccaggctgttaagtctgggaaattccaagcttatgactggggaagcccagttcagaataggatgcactatgatcagagcatggtttggagccaatggcatcagcatcacctatgaatgcagaatctcaggctgttccccagatctactgaaacagaatttttacttcaacaagatcttcaggtaattcacaggcccattagaatttgacaagcact

SEQ ID NO: 5489 - DNA, 1001 bp, synthetic construct
  misc_feature 1..1001: note = Synthetic polypeptide
  source 1..1001: mol_type = other DNA
atgtggctgcttttaacaatggcaagtttgatatctgtactggggactacacatggtttgtttggaaaattacatcctggaagccctgaagtgactatgaacattagtcagatgattacttattggggatacccaaatgaagaatatgaagttgtgactgaagatggttatattcttgaagtcaatagaattccttatgggaagaaaaattcagggaatacagatgctggttatgatgtgtggctgggcaacagcagaggaaacacctgggccagaagaaacttgtactattcaccagattcagttgaattctgggctttcagctttgatgaaatggctaaatatgaccttccagccacaatcgacttcattgtaaagaaaactggacagaagcagctacactatgttggccattcccagggcaccaccattggttttattgccttttccaccaatcccagcctggctaaaagaatcaaaaccttctatgctctagctcctgttgccactgtgaagtatacaaaaagccttataaacaaacttagatttgttcctcaatccctcttcaagtttatatttggtgacaaaatattctacccacacaacttctttgatcaatttcttgctactgaagtgtgctcccgtgagatgctgaatctcctttgcagcaatgccttatttataatttgtggatttgacagtaagaactttaacacgagtcgcttggatgtgtatctatcacataatccagcaggaacttctgttcaaaacatgttccattggacccaggctgttaagtctgggaaattccaagcttatgactggggaagcccagttcagaataggatgcactatgatcagagcatggtttggagccaatggcatcagcatcacctatgaatgcagaatctcaggctgttccccagatctactgaaacagaatttttacttcaacaagatcttcaggtaattcacaggcccattagaatttgacaagcact

SEQ ID NO: 5490 - DNA, 1100 bp, synthetic construct
  misc_feature 1..1100: note = Synthetic polypeptide
  source 1..1100: mol_type = other DNA
atgtggctgcttttaacaatggcaagtttgatatctgtactggggactacacatggtttgtttggaaaattacatcctggaagccctgaagtgactatgaacattagtcagatgattacttattggggatacccaaatgaagaatatgaagttgtgactgaagatggttatattcttgaagtcaatagaattccttatgggaagaaaaattcagggaatacaggccagagacctgttgtgtttttgcagcatggtttgcttgcatcagccacaaactggatttccaacctgccgaacaacagccttgccttcattctggcagatgctggttatgatgtgtggctgggcaacagcagaggaaacacctgggccagaagaaacttgtactattcaccagattcagttgaattctgggctttcagctttgatgaaatggctaaatatgaccttccagccacaatcgacttcattgtaaagaaaactggacagaagcagctacactatgttggccattcccagggcaccaccattggttttattgccttttccaccaatcccagcctggctaaaagaatcaaaaccttctatgctctagctcctgttgccactgtgaagtatacaaaaagccttataaacaaacttagatttgttcctcaatccctcttcaagtttatatttggtgacaaaatattctacccacacaacttctttgatcaatttcttgctactgaagtgtgctcccgtgagatgctgaatctcctttgcagcaatgccttatttataatttgtggatttgacagtaagaactttaacacgagtcgcttggatgtgtatctatcacataatccagcaggaacttctgttcaaaacatgttccattggacccaggctgttaagtctgggaaattccaagcttatgactggggaagcccagttcagaataggatgcactatgatcagagcatggtttggagccaatggcatcagcatcacctatgaatgcagaatctcaggctgttccccagatctactgaaacagaatttttacttcaacaagatcttcaggtaattcacaggcccattagaatttgacaagcact

SEQ ID NO: 5491 - DNA, 1031 bp, synthetic construct
  misc_feature 1..1031: note = Synthetic polypeptide
  source 1..1031: mol_type = other DNA
atgttctccaacgcaaacagcaggtccaaaatgtggctgcttttaacaatggcaagtttgatatctgtactggggactacacatggtttgtttggaaaattacatcctggaagccctgaagtgactatgaacattagtcagatgattacttattggggatacccaaatgaagaatatgaagttgtgactgaagatggttatattcttgaagtcaatagaattccttatgggaagaaaaattcagggaatacagatgctggttatgatgtgtggctgggcaacagcagaggaaacacctgggccagaagaaacttgtactattcaccagattcagttgaattctgggctttcagctttgatgaaatggctaaatatgaccttccagccacaatcgacttcattgtaaagaaaactggacagaagcagctacactatgttggccattcccagggcaccaccattggttttattgccttttccaccaatcccagcctggctaaaagaatcaaaaccttctatgctctagctcctgttgccactgtgaagtatacaaaaagccttataaacaaacttagatttgttcctcaatccctcttcaagtttatatttggtgacaaaatattctacccacacaacttctttgatcaatttcttgctactgaagtgtgctcccgtgagatgctgaatctcctttgcagcaatgccttatttataatttgtggatttgacagtaagaactttaacacgagtcgcttggatgtgtatctatcacataatccagcaggaacttctgttcaaaacatgttccattggacccaggctgttaagtctgggaaattccaagcttatgactggggaagcccagttcagaataggatgcactatgatcagagcatggtttggagccaatggcatcagcatcacctatgaatgcagaatctcaggctgttccccagatctactgaaacagaatttttacttcaacaagatcttcaggtaattcacaggcccattagaatttgacaagcact

SEQ ID NO: 5492 - DNA, 1024 bp, synthetic construct; identical to SEQ ID NO: 4205
  misc_feature 1..1024: note = Synthetic polypeptide
  source 1..1024: mol_type = other DNA

SEQ ID NO: 5493 - DNA, 970 bp, synthetic construct; identical to SEQ ID NO: 4206
  misc_feature 1..970: note = Synthetic polypeptide
  source 1..970: mol_type = other DNA

SEQ ID NO: 5494 - DNA, 1072 bp, synthetic construct; identical to SEQ ID NO: 4207
  misc_feature 1..1072: note = Synthetic polypeptide
  source 1..1072: mol_type = other DNA

SEQ ID NO: 5495 - DNA, 661 bp, synthetic construct; identical to SEQ ID NO: 4208
  misc_feature 1..661: note = Synthetic polypeptide
  source 1..661: mol_type = other DNA

SEQ ID NO: 5496 - DNA, 5505 bp, synthetic construct; identical to SEQ ID NO: 1545
  misc_feature 1..5505: note = Synthetic polypeptide
  source 1..5505: mol_type = other DNA

SEQ ID NO: 5497 - DNA, 5418 bp, synthetic construct; identical to SEQ ID NO: 1546
  misc_feature 1..5418: note = Synthetic polypeptide
  source 1..5418: mol_type = other DNA

SEQ ID NO: 5498 - DNA, 1834 bp, synthetic construct; identical to SEQ ID NO: 133
  misc_feature 1..1834: note = Synthetic polypeptide
  source 1..1834: mol_type = other DNA

SEQ ID NO: 5499 - DNA, 1765 bp, synthetic construct; identical to SEQ ID NO: 135
  misc_feature 1..1765: note = Synthetic polypeptide
  source 1..1765: mol_type = other DNA

SEQ ID NO: 5500 - DNA, 610 bp, synthetic construct; identical to SEQ ID NO: 163
  misc_feature 1..610: note = Synthetic polypeptide
  source 1..610: mol_type = other DNA

SEQ ID NO: 5501 - DNA, 1357 bp, synthetic construct; identical to SEQ ID NO: 3433
  misc_feature 1..1357: note = Synthetic polypeptide
  source 1..1357: mol_type = other DNA

SEQ ID NO: 5502 - DNA, 107 bp, synthetic construct
  misc_feature 1..107: note = Synthetic polypeptide
  source 1..107: mol_type = other DNA
atgttcgaagagcctgagtgggccgaggcggccccagtagccgcgggccttgggcccgtaatctcacgacctccgcctgcggcctcctcgcaaaacaagctttccag

SEQ ID NO: 5503 - DNA, 103 bp, synthetic construct; identical to SEQ ID NO: 173
  misc_feature 1..103: note = Synthetic polypeptide
  source 1..103: mol_type = other DNA

SEQ ID NO: 5504 - DNA, 569 bp, synthetic construct; identical to SEQ ID NO: 1768
  misc_feature 1..569: note = Synthetic polypeptide
  source 1..569: mol_type = other DNA

SEQ ID NO: 5505 - DNA, 497 bp, synthetic construct; identical to SEQ ID NO: 1769
  misc_feature 1..497: note = Synthetic polypeptide
  source 1..497: mol_type = other DNA

SEQ ID NO: 5506 - DNA, 882 bp, synthetic construct
  misc_feature 1..882: note = Synthetic polypeptide
  source 1..882: mol_type = other DNA
atgaagtggctgctgctgctgggtctggtggcgctctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgacaagagtggcagcgtggtgatctttggtggcattgactcttcttactacactggaagtctgaactgggtgcctgttaccgtcgagggttactggcagatcaccgtggacaggccgggagctccctgcagcctggaactgtgaggctgtcttgtttcgcttggcgtttcccatgcctggcagagggtaggcacttgggaaatatttgtagggtaaatgaat

SEQ ID NO: 5507 - DNA, 420 bp, synthetic construct
  misc_feature 1..420: note = Synthetic polypeptide
  source 1..420: mol_type = other DNA
atggtaagtggaaacaacagtgacggtgcccactgcatgggccctggcctaagaggaaaagaaaccacattggtcacaccccaggacagccctggaaagtgcccaatcaacggtcgctctgaggaggcaacagcagatggtcacacaaatggacgaacaaaaaaattcatgtcttctcccctcactttccacagcgatgacaagagtggcagcgtggtgatctttggtggcattgactcttcttactacactggaagtctgaactgggtgcctgttaccgtcgagggttactggcagatcaccgtggacaggccgggagctccctgcagcctggaactgtgaggctgtcttgtttcgcttggcgtttcccatgcctggcagagggtaggcacttgggaaatatttgtagggtaaatgaat

SEQ ID NO: 5508 - DNA, 434 bp, synthetic construct; identical to SEQ ID NO: 3710
  misc_feature 1..434: note = Synthetic polypeptide
  source 1..434: mol_type = other DNA

SEQ ID NO: 5509 - DNA, 689 bp, synthetic construct; identical to SEQ ID NO: 4459
  misc_feature 1..689: note = Synthetic polypeptide
  source 1..689: mol_type = other DNA

SEQ ID NO: 5510 - DNA, 444 bp, synthetic construct
  misc_feature 1..444: note = Synthetic polypeptide
  source 1..444: mol_type = other DNA
atggacttcaccgcgcagcccaagcctgccactgccctctgtggcgtcgtgagtgccgacgggaagatcgcttaccctccgggggtaaaagagatcaccgacaagatcaccacggacgagatgatcaaacgcctgaaggggaaaaccaactgccttttcacttgagctgtctagaaaggcccatgtagtgtggaactgaagcctttcaacaacagcaagtgtcaacttagaaccgtaagaatgagttaccttcaaaacacaccctccacgcccagtcaagccttcagataactgcagccttgaccaggtacagcctcttgagagattccaggcccacacgacttagctaagccactttccaattcttcaaccacatatgataaatacatgttattgttttaaggcactgagttttggggtattttgttacatagcaataattaa

SEQ ID NO: 5511 - DNA, 584 bp, synthetic construct; identical to SEQ ID NO: 4502
  misc_feature 1..584: note = Synthetic polypeptide
  source 1..584: mol_type = other DNA

SEQ ID NO: 5512 - DNA, 623 bp, synthetic construct; identical to SEQ ID NO: 4503
  misc_feature 1..623: note = Synthetic polypeptide
  source 1..623: mol_type = other DNA

SEQ ID NO: 5513 - DNA, 428 bp, synthetic construct; identical to SEQ ID NO: 4504
  misc_feature 1..428: note = Synthetic polypeptide
  source 1..428: mol_type = other DNA

SEQ ID NO: 5514 - DNA, 2962 bp, synthetic construct; identical to SEQ ID NO: 2377
  misc_feature 1..2962: note = Synthetic polypeptide
  source 1..2962: mol_type = other DNA

SEQ ID NO: 5515 - DNA, 2899 bp, synthetic construct; identical to SEQ ID NO: 2378
  misc_feature 1..2899: note = Synthetic polypeptide
  source 1..2899: mol_type = other DNA

SEQ ID NO: 5516 - DNA, 2902 bp, synthetic construct; identical to SEQ ID NO: 2379
  misc_feature 1..2902: note = Synthetic polypeptide
  source 1..2902: mol_type = other DNA

SEQ ID NO: 5517 - DNA, 2839 bp, synthetic construct; identical to SEQ ID NO: 2380
  misc_feature 1..2839: note = Synthetic polypeptide
  source 1..2839: mol_type = other DNA

SEQ ID NO: 5518 - DNA, 645 bp, synthetic construct; identical to SEQ ID NO: 137
  misc_feature 1..645: note = Synthetic polypeptide
  source 1..645: mol_type = other DNA

SEQ ID NO: 5519 - DNA, 856 bp, synthetic construct
  misc_feature 1..856: note = Synthetic polypeptide
  source 1..856: mol_type = other DNA
atgggacccccctcagcccctccctgcagattgcatgtcccctggaaggaggtcctgctcacagcctcacttctaaccttctggaacccacccaccactgccaagctcactattgaatccacgccgttcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtatacccggagctgcccaagccctccatctccagcaacaactccaaccccgtggaggacaaggatgctgtggccttcacctgtgaacctgaggtgtgtgccactcagagacttcacctaactagagacaggcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtatcagatctatcttgtcaatcccaacgttttacataaaataagagatcctttagtgcacccagtgactgacattagcagcatctttaacacagccgtgtgttca

SEQ ID NO: 5520 - DNA, 1721 bp, synthetic construct; identical to SEQ ID NO: 1726
  misc_feature 1..1721: note = Synthetic polypeptide
  source 1..1721: mol_type = other DNA

SEQ ID NO: 5521 - DNA, 665 bp, synthetic construct; identical to SEQ ID NO: 2195
  misc_feature 1..665: note = Synthetic polypeptide
  source 1..665: mol_type = other DNA

SEQ ID NO: 5522 - DNA, 1151 bp, synthetic construct
  misc_feature 1..1151: note = Synthetic polypeptide
  source 1..1151: mol_type = other DNA
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgagccacccaaacccttcatcaccagcaacaactccaaccccgtggaggatgaggatgctgtagccttaacctgtgaacctgagattcagaacacaacctacctgtggtggagattgcagtgagcccagatcgcaccactgcactccagtctggcaacagagcaagactccatctcaaaaagaaaagaaaagaa

SEQ ID NO: 5523 - DNA, 1154 bp, synthetic construct
  misc_feature 1..1154: note = Synthetic polypeptide
  source 1..1154: mol_type = other DNA
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtggagattgcagtgagcccagatcgcaccactgcactccagtctggcaacagagcaagactccatctcaaaaagaaaagaaaagaa

SEQ ID NO: 5524 - DNA, 601 bp, synthetic construct
  misc_feature 1..601: note = Synthetic polypeptide
  source 1..601: mol_type = other DNA
taatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctcagagccacccaaacccttcatcaccagcaacaactccaaccccgtggaggatgaggatgctgtagccttaacctgtgaacctgagattcagaacacaacctacctgtggtggagattgcagtgagcccagatcgcaccactgcactccagtctggcaacagagcaagactccatctcaaaaagaaaagaaaagaa

SEQ ID NO: 5525 - DNA, 1041 bp, synthetic construct; identical to SEQ ID NO: 969
  misc_feature 1..1041: note = Synthetic polypeptide
  source 1..1041: mol_type = other DNA

SEQ ID NO: 5526 - DNA, 195 bp, synthetic construct; identical to SEQ ID NO: 4558
  misc_feature 1..195: note = Synthetic polypeptide
  source 1..195: mol_type = other DNA

SEQ ID NO: 5527 - DNA, 808 bp, synthetic construct
  misc_feature 1..808: note = Synthetic polypeptide
  source 1..808: mol_type = other DNA
atgtggttcatgtacctgctgagctggctgtcgctcttcatccaggtggccttcatcacgctggctgtcgcggctggactctattacctggcagaactgatagaagaatacacagtggccaccagcaggatcataaaatacatgatctggttctccaccgctgtactgattggcctctacgtctttgagcgcttccccaccagcatgattggagtgggcctattcaccaacctcgtctactttggcctcctccagaccttccccttcatcatgctgacctcgcctaacttcatcctgtcgtgtggactagtggtggtgaatcattacctagcatttcagttttttgcagaagaatattatcccttctcagaggtgcacagacaattcaggtccatggcccagatggtacttgctgtcttctgcaaacctgccccttctgggtacttcccttgaccccgagatcactcaggagccagacaggaaacttattctattcctgttttctctttctgcccaccacatccaatctctcaaaacggtcaggtctaccttaacatctcttgatttgagccactcccactgtcatcagctttcacctggattatcgtgacagcctcctactgcttctctatcatgtggccagagctatcttcctaaaatgcattgcatagttgatcaagtcactctctggcctaaaaccttccttggctccctgctgccctcaggataaagtctggacccctcagcatggcttgtgagactcatggtgtccttgtccctgctcacctctctggtctcatcacttgcc

SEQ ID NO: 5528 - DNA, 91 bp, synthetic construct; identical to SEQ ID NO: 223
  misc_feature 1..91: note = Synthetic polypeptide
  source 1..91: mol_type = other DNA

SEQ ID NO: 5529 - DNA, 415 bp, synthetic construct; identical to SEQ ID NO: 4339
  misc_feature 1..415: note = Synthetic polypeptide
  source 1..415: mol_type = other DNA

SEQ ID NO: 5530 - DNA, 1184 bp, synthetic construct
  misc_feature 1..1184: note = Synthetic polypeptide
  source 1..1184: mol_type = other DNA
gcctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatgacagagacggccggcaaagcccagcagcaaggagagagcctgggacagagtctcccatgacacagaggtgccagccccgccgaggcctccatcccagatgcccggcctccagaaccaggacggaataaacgtctgttgtttaagccacgcagtctggggtgctgtgttgccagggccacagttaacggatac

SEQ ID NO: 5531 - DNA, 1079 bp, synthetic construct
  misc_feature 1..1079: note = Synthetic polypeptide
  source 1..1079: mol_type = other DNA
gcctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatgacagagacggccggcaaagcccagcagcaaggagagagcctgggacagagtctcccatgacacagaggtgccagccccgccgaggcctccatcccagatgcccggcctccagaaccaggacggaataaacgtctgttgtttaagccacgcagtctggggtgctgtgttgccagggccacagttaacggatac

SEQ ID NO: 5532 - DNA, 672 bp, synthetic construct
  misc_feature 1..672: note = Synthetic polypeptide
  source 1..672: mol_type = other DNA
atggttttggatgaccttccaaacttagaagacatctatacttccttgtgttcatcaacaatggaagactcagagatggattttgactctggactagaagatgatgacacaaaaagtgatagtattttggaggattccacaatttttgtggccttcaaaggaaatatagatgataaagacttcaaatggaaattagatgcaatattgaaaaacgtgcccaatttgttacacatggagtccagcaagctaaaagtacagaaggtggagccctggaacagcgtgcgtgtgacattcaacatcccccgggaagcagcggagcggctacggatccttgctcagagcaacaaccagcagcttcgggatttagggattctctccgttcagattgaaggggaaggtgctattaacctggctttggctcagaaccgaagccaagatgtgagaatgaatggacccatgggagctggaaattcagttaggatggaggcgggatttcctatggcaagtggtccagacccttgctaattgaactgctcaaggatgtacttcaggaagaagaaaattgaacctaagatggaagaaataagatctaagaaggaatggtgagctaaataattgataagcatggggtaaatctaaataagcattgacttatttagtaataatgatgat

SEQ ID NO: 5533 - DNA, 245 bp, synthetic construct
  misc_feature 1..245: note = Synthetic polypeptide
  source 1..245: mol_type = other DNA
atggagccgccgaatctctatccggtgaagctctacgtgtacgacctgtccaaaggcctggcccggcggctcagccccatcatgctggggaaacaactggaaggcatctgggaggaggatgctactggcatcttgtggatagaggcagggacgctgctcaacagactagaatgcacaggacagccccacacaacaaagaagtatccagcctcaaatgtcaatagtgccaagattgagaagccctg

SEQ ID NO: 5534 - DNA, 831 bp, synthetic construct; identical to SEQ ID NO: 4340
  misc_feature 1..831: note = Synthetic polypeptide
  source 1..831: mol_type = other DNA

SEQ ID NO: 5535 - DNA, 848 bp, synthetic construct; identical to SEQ ID NO: 4341
  misc_feature 1..848: note = Synthetic polypeptide
  source 1..848: mol_type = other DNA

SEQ ID NO: 5536 - DNA, 809 bp, synthetic construct; identical to SEQ ID NO: 4593
  misc_feature 1..809: note = Synthetic polypeptide
  source 1..809: mol_type = other DNA

SEQ ID NO: 5537 - DNA, 836 bp, synthetic construct; identical to SEQ ID NO: 4594
  misc_feature 1..836: note = Synthetic polypeptide
  source 1..836: mol_type = other DNA

SEQ ID NO: 5538 - DNA, 512 bp, synthetic construct; identical to SEQ ID NO: 4595
  misc_feature 1..512: note = Synthetic polypeptide
  source 1..512: mol_type = other DNA

SEQ ID NO: 5539 - DNA, 525 bp, synthetic construct
  misc_feature 1..525: note = Synthetic polypeptide
  source 1..525: mol_type = other DNA
atgacggaactagagacagccatgggcatgatcatagacgtcttttcccgatattcgggcagcgagggcagcacgcagaccctgaccaagggggagctcaaggtgctgatggagaaggagctaccaggcttcctgcagagtggaaaagacaaggatgccgtggataaattgctcaaggacctggatgccaatggagatgcccaggtggacttcagtgagttcatagtgttcgtggctgcaatcacgtctgcctttcacaagcactttgagaggctgaggcaggcggatcacaaggtcaggagatcgagaccatcctggctaacatggtgaaaccctgtctactaaaaatacaaaaaaaaaaaaaaaaaattagccaggcatggtggtgggcgcctgtggtcccagctactcaggaggctgtggcgggaaaatggtgtgaacccgggagtcggagcggagatgacgccactgcactccagccggggcgacagagcaagactctgtctgaaaaaaaagaaaaaagaa

SEQ ID NO: 5540 - DNA, 882 bp, synthetic construct
  misc_feature 1..882: note = Synthetic polypeptide
  source 1..882: mol_type = other DNA
atgaagtggctgctgctgctgggtctggtggcactctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtggaaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacaggccgggagctccctgcagcctggaactgtgaggctgtcttgtttcgcttggcgtttcccatgcctggcagagggtaggcacttgggaaatatttgtagggtaaatgaat

SEQ ID NO: 5541 - DNA, 663 bp, synthetic construct
  misc_feature 1..663: note = Synthetic polypeptide
  source 1..663: mol_type = other DNA
atggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacaggccgggagctccctgcagcctggaactgtgaggctgtcttgtttcgcttggcgtttcccatgcctggcagagggtaggcacttgggaaatatttgtagggtaaatgaat

SEQ ID NO: 5542 - DNA, 420 bp, synthetic construct
  misc_feature 1..420: note = Synthetic polypeptide
  source 1..420: mol_type = other DNA
atggtaagtggaaataacagtgacagtgcccactgcataggcactggcctaagaggaaaagaaaccacattagtcacaccgcaggacagccctagaaagtgcccaatcaagggtagccctgaggaggcaacagcagatggtcacacaaatggacgaacaaaaaaattcatgtcttctcccctcactttccacagcgatgaccagagtggcagcgtggtgatctttggtggcattgactcttcttactacactggaagtctgaactgggtgcctgttaccgtcgagggttactggcagatcaccgtggacaggccgggagctccctgcagcctggaactgtgaggctgtcttgtttcgcttggcgtttcccatgcctggcagagggtaggcacttgggaaatatttgtagggtaaatgaat

SEQ ID NO: 5543 - DNA, 1070 bp, synthetic construct
  misc_feature 1..1070: note = Synthetic polypeptide
  source 1..1070: mol_type = other DNA
atgcaaaaaatcaaatctctcatgacccgacagggtctgaaaagccctcaagaaagcctcagtgatcttggtgccatagagagtctccgggtccctggaaaggaagaattcagggaacttcgagaacagccaagtgaccctcaagctgaacaagagcttattaatagtattgaacaagtatatttttctgtggattcatttgatattgttaaatatgagctggagaagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgctggaggaggaagattatccaggagctattcagttgtgccttgaatgtcaaaaagctgccagcacttttaaacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagaaattgccatagccacttcggcctttagcaaccagcaccctgatcagtcagcagccatcaacattgagacaagaccctcgaccagaaaaaagatcgactcactgaaggcccagatgattattagcatttttttaaattttagcaattttttaaaattaaggtttatatgttgttttttaaagacataatgctattacacactttagactatagaacagtgtaaatgtaacttttatatacactgggaaataaaaaaatttgctttgtga

SEQ ID NO: 5544 - DNA, 503 bp, synthetic construct
  misc_feature 1..503: note = Synthetic polypeptide
  source 1..503: mol_type = other DNA
atgctggaggaggaagattatccaggagctattcagttgtgccttgaatgtcaaaaagctgccagcacttttaaacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagaaattgccatagccacttcggcctttagcaaccagcaccctgatcagtcagcagccatcaacattgagacaagaccctcgaccagaaaaaagatcgactcactgaaggcccagatgattattagcatttttttaaattttagcaattttttaaaattaaggtttatatgttgttttttaaagacataatgctattacacactttagactatagaacagtgtaaatgtaacttttatatacactgggaaataaaaaaatttgctttgtga

SEQ ID NO: 5545 - DNA, 980 bp, synthetic construct
  misc_feature 1..980: note = Synthetic polypeptide
  source 1..980: mol_type = other DNA
atgttaactttggaagaattcagggaacttcgagaacagccaagtgaccctcaagctgaacaagagcttattaatagtattgaacaagtatatttttctgtggattcatttgatattgttaaatatgagctggagaagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgctggaggaggaagattatccaggagctattcagttgtgccttgaatgtcaaaaagctgccagcacttttaaacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagaaattgccatagccacttcggcctttagcaaccagcaccctgatcagtcagcagccatcaacattgagacaagaccctcgaccagaaaaaagatcgactcactgaaggcccagatgattattagcatttttttaaattttagcaattttttaaaattaaggtttatatgttgttttttaaagacataatgctattacacactttagactatagaacagtgtaaatgtaacttttatatacactgggaaataaaaaaatttgctttgtga

SEQ ID NO: 5546 - DNA, 430 bp, synthetic construct
  misc_feature 1..430: note = Synthetic polypeptide
  source 1..430: mol_type = other DNA
aacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagaaattgccatagccacttcggcctttagcaaccagcaccctgatcagtcagcagccatcaacattgagacaagaccctcgaccagaaaaaagatcgactcactgaaggcccagatgattattagcatttttttaaattttagcaattttttaaaattaaggtttatatgttgttttttaaagacataatgctattacacactttagactatagaacagtgtaaatgtaacttttatatacactgggaaataaaaaaatttgctttgtga

SEQ ID NO: 5547 - DNA, 882 bp, synthetic construct
  misc_feature 1..882: note = Synthetic polypeptide
  source 1..882: mol_type = other DNA
atgaagtggctgctgctgctgggtctggtggcgctctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacaggccgggagctccctgcagcctggaactgtgaggctgtcttgtttcgcttggcgtttcccatgcctggcagagggtaggcacttgggaaatatttgtagggtaaatgaat

SEQ ID NO: 5548 - DNA, 420 bp, synthetic construct; identical to SEQ ID NO: 5542
  misc_feature 1..420: note = Synthetic polypeptide
  source 1..420: mol_type = other DNA

SEQ ID NO: 5549 - DNA, 886 bp, synthetic construct
  misc_feature 1..886: note = Synthetic polypeptide
  source 1..886: mol_type = other DNA
atgaagtggctgctgctgctgggtctggtggcgctctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgacaagagtggcagcgtggtgatctttggtggcattgactcttcttactacactggaagtctgaactgggtgcctgttaccgtcgagggttactggcagatcaccgtggacagctaggccgggagctccctgcagcctggaactgtgaggctgtcttgtttcgcttggcgtttcccatgcctggcagagggtaggcacttgggaaatatttgtagggtaaatgaat

SEQ ID NO: 5550 - DNA, 424 bp, synthetic construct
  misc_feature 1..424: note = Synthetic polypeptide
  source 1..424: mol_type = other DNA
atggtaagtggaaacaacagtgacggtgcccactgcatgggccctggcctaagaggaaaagaaaccacattggtcacaccccaggacagccctggaaagtgcccaatcaacggtcgctctgaggaggcaacagcagatggtcacacaaatggacgaacaaaaaaattcatgtcttctcccctcactttccacagcgatgacaagagtggcagcgtggtgatctttggtggcattgactcttcttactacactggaagtctgaactgggtgcctgttaccgtcgagggttactggcagatcaccgtggacagctaggccgggagctccctgcagcctggaactgtgaggctgtcttgtttcgcttggcgtttcccatgcctggcagagggtaggcacttgggaaatatttgtagggtaaatgaat

SEQ ID NO: 5551 - DNA, 842 bp, synthetic construct
  misc_feature 1..842: note = Synthetic polypeptide
  source 1..842: mol_type = other DNA
atgaagtggctgctgctgctgggtctggtggcactctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtggaaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgcttccaccactcccccgctgtatgaccttgggcaggtggcctcacctccctcaggctcagtgtcctcatggtaagtggaaataacagtgacagtgcccactgcataggcactggcctaagaggaaaagaaaccacattagtcacaccgcaggacagccctagaaagtgcccaatcaagggtagccct

SEQ ID NO: 5552 - DNA, 623 bp, synthetic construct
  misc_feature 1..623: note = Synthetic polypeptide
  source 1..623: mol_type = other DNA
atggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgcttccaccactcccccgctgtatgaccttgggcaggtggcctcacctccctcaggctcagtgtcctcatggtaagtggaaataacagtgacagtgcccactgcataggcactggcctaagaggaaaagaaaccacattagtcacaccgcaggacagccctagaaagtgcccaatcaagggtagccct

SEQ ID NO: 5553 - DNA, 343 bp, synthetic construct; identical to SEQ ID NO: 4070
  misc_feature 1..343: note = Synthetic polypeptide
  source 1..343: mol_type = other DNA

SEQ ID NO: 5554 - DNA, 391 bp, synthetic construct; identical to SEQ ID NO: 4273
  misc_feature 1..391: note = Synthetic polypeptide
  source 1..391: mol_type = other DNA

SEQ ID NO: 5555 - DNA, 1620 bp, synthetic construct
  misc_feature 1..1620: note = Synthetic polypeptide
  source 1..1620: mol_type = other DNA
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggagattgcagtgagcccagatcgcaccactgcactccagtctggcaacagagcaagactccatctcaaaaagaaaagaaaagaa

SEQ ID NO: 5556 - DNA, 1623 bp, synthetic construct
  misc_feature 1..1623: note = Synthetic polypeptide
  source 1..1623: mol_type = other DNA
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggagattgcagtgagcccagatcgcaccactgcactccagtctggcaacagagcaagactccatctcaaaaagaaaagaaaagaa

SEQ ID NO: 5557 - DNA, 455 bp, synthetic construct
  misc_feature 1..455: note = Synthetic polypeptide
  source 1..455: mol_type = other DNA
ccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggagattgcagtgagcccagatcgcaccactgcactccagtctggcaacagagcaagactccatctcaaaaagaaaagaaaagaa

SEQ ID NO: 5558 - DNA, 1198 bp, synthetic construct
  misc_feature 1..1198: note = Synthetic polypeptide
  source 1..1198: mol_type = other DNA
atgcctcaaacccgatcccaggcacaggctacaatcagttttccaaaaaggaagctgtctcgggcattgaacaaagctaaaaactccagtgatgccaaactagaaccaacaaatgtccaaaccgtaacctgttctcctcgtgtaaaagccctgcctctcagccccaggaaacgtctgggcgatgacaacctatgcaacactccccatttacctccttgttctccaccaaagcaaggcaagaaagagaatggtccccctcactcacatacacttaagggacgaagattggtatttgacaatcagctgacaattaagtctcctagcaaaagagaactagccaaagttcaccaaaacaaaatactttcttcagttagaaaaagtcaagagatcacaacaaattctgagcagagatgtccactgaagaaagaatctgcatgtgtgagactattcaagcaagaaggcacttgctaccagcaagcaaagctggtcctgaacacagctgtcccagatcggctgcctgccagggaaagggagatggatgtcatcaggaatttcttgagggaacacatctgtgggaaaaaagctggaagcctttacctttctggtgctcctggaactggaaaaactgcctgcttaagccggattctgcaagacctcaagaaggaactgaaaggctttaaaactatcatgctgaattgcatgtccttgaggactgcccaggctgtattcccagctattgctcaggagatttgtcaggaagaggtatccaggccagctgggaaggacatgatgaggaaattggaaaaacatatgactgcagagaagggccccatgattgtgttggtattggacgagatggatcaactggacagcaaaggccaggatgtattgtacacgctatttgaatggccatggctaagcaattctcacttggtgctgattggtattgctaataccctggatctcacagatagaattctacctaggcttcaagctagagaaaaatgtaagccacagctgttgaacttcccaccttataccagaaatcagatagtcactattttgcaagatcgacttaatcaggtatctagagatcaggttctggacaatgctgcagttcaattctgtgcccgcaaagtctctgctgtttcaggagatgttcgcaaagcactggatgtttgcagaaattttttttata

SEQ ID NO: 5559 - DNA, 1893 bp, synthetic construct
  misc_feature 1..1893: note = Synthetic polypeptide
  source 1..1893: mol_type = other DNA
atggcacaggagaaaatgaaactaggtttcaagtcgctgccgagttccactaccgcagacggcaacattctgagaagagtcaacagtgcccctttgatcaatggacttggttttaattcacaggtgttgcaagctgacatgttaagaattaggacaaacagaacaacatttaggaatcgacgctctctgttgttgccacctcctccctttcatggttccatcagccgccttcatcaaatcaaacagtctccctctgatgccgagcggaagctggactgtactgctgccatctcggctcactgcaacctccctgcctgattctcctgcctcagcctgccgagtgcctgcgattgcaggcgcgcgcagccacacctgactggttttcgtatttttttggtggagacggggtttcgctgtgttggccgggctggtctccagctcctaaccgcaagtgatctgccagcctcggcctcccgaggtgccgggattgcagacggagtctggttcactcagtgctcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcatctctgcctggccgcccatcgtctgggaggtgaggagcccctctgcctggctgcccagtctggaaagtgaggagcgtctctgcccggccgccatcccatctaggaagtgaggagcgcctcttcccggccgccatcccatctaggaagtgaggagcgtctctgccccgctgccccgtctgggatgtgaggagcgcctctgcccggccgcgaccccgtctgggaggtgaggagcatctctgcccggccgccccgtctgagaagtgaggagaccctccgcctggcaaccgccccgtctgagaagtgaggagcccctccgcccagcagccgccccgtctgagaagtgaggagcccctccgcccggcagccacaccgtctgggaagtgaggagcgtctctgcccggcagccaccccgtccgggagggaggtgggggtcagcccccgccaggccagccgccccatccgggaggtgaggggtgcctctgcccagccgcccctactgggaagtgaggagcccctctgcccggccatccgccccatccaggagggaggtgggggggtcagtcccccgcccggccagccgccccgtccgggagggaggtgggggggtcagccccccgcccggccagccgcctcgtccgggaggtgaggggcgcctctgcccggccgcccctactgggaagtgaggagcccctctgcccggccagccgccccgtctgggaggtgtacccaacagctcattgagaacgggccatgatgacaatggcggttttgtggaatagaaaggggggaaaggtggggaaaagattgagaaatcggatggttgccgtgtctgtgtagaaagaagtagacatgggagacttttcattttgttctgtactaagaattcttctgccttgggatcctgtagatctgtgaccttacccccaaccctgtgctctctgaaacatgtgctgtgtccactcagggttaaatggattaagggcggtgcaagatgtgctttgttaaacagatgcttgaaggcagcgtgctcgttaagagtcatcaccactccctattctcaagtacccagggacacaaacactgcggaaggccgcagggtcctctgcctaggaaaaccagagacctttgttcacttgtttatctgctgaccttccctccactattgtcctgagaccctgccaaatccccctctgcgagaaacacgcaagaatgatcaataaaaaaaaaaacaaaaaa

SEQ ID NO: 5560 - DNA, 1142 bp, synthetic construct; identical to SEQ ID NO: 2159
  misc_feature 1..1142: note = Synthetic polypeptide
  source 1..1142: mol_type = other DNA

SEQ ID NO: 5561 - DNA, 400 bp, synthetic construct; identical to SEQ ID NO: 4369
  misc_feature 1..400: note = Synthetic polypeptide
  source 1..400: mol_type = other DNA

SEQ ID NO: 5562 - DNA, 279 bp, synthetic construct
  misc_feature 1..279: note = Synthetic polypeptide
  source 1..279: mol_type = other DNA
atgaacacccgcaatagagtggtgaactccgggctcggcgcctcccctgcctcccgcccgacccgggatccccaggacccttctgggcggcaaggggagctgagccccgtggaagaccagagagagggtttggaggcagcccctaagggcccttcgcgggagagcgtcgtgcacgcgggccagaggcggaatttcatgtcttctgccagtgtctgtgaaacagtaacaggctaacttattagcttgtaagtggaatccaatcaaatcccagacctgaca

SEQ ID NO: 5563 - DNA, 865 bp, synthetic construct; identical to SEQ ID NO: 366
  misc_feature 1..865: note = Synthetic polypeptide
  source 1..865: mol_type = other DNA

SEQ ID NO: 5564 - DNA, 1385 bp, synthetic construct
  misc_feature 1..1385: note = Synthetic polypeptide
  source 1..1385: mol_type = other DNA
atggcaacagaatttataaagagttgctgtggaggatgtttctatggtgaaacagaaaaacacaacttttctgtggaaagagattttaaagcagcagtcccaaatagtcaaaatgctactatctctgtacctccattgacttctgtttctgtaaagcctcagcttggctgtactgaggattatttgctttccaaattaccatctgatggcaaagaagtaccatttgtggtgcccaagtttaagttatcttacattcaacccaggacacaagaaactccttcacatctggaagaacttgaaggatctgccagagcatcttttggagatcgaaaggtagaactttccagttcatcccagcacggacctagctatgatgtgtataacccattctatatgtatcagcacatttcacctgatttgagtcgacgctttcctccccgttcagaagtgaagagactgtatggatcggtttgtgatttaaggacgaacaaacttcccggttcccctgggctaagcaaatctatgtttgatcttacaaactcatctcagcgattcatccagagacatgattcattgtccagtgtacccagtagttcttcttcaaggaaaaattctcaggggagtaacagaagcctggatacaattactctatcaggagatgaaagggactttgggagactgaatgtgaaattgttttataattcttcagtagaacagatctggatcacagttttacagtgcagagatttaagttggccctctagttatggagacactcctactgtttctataaaaggaatacttacattgcccaaaccagtgcatttcaaatcttcagccaaggaaggttccaacgctattgaatttatggaaacgtttgtatttgctattaaacttcaaaatctacaaactgtaagacttgtatttaagattcaaacccagactcccaggaagaaaaccattggagaatgctcaatgtcactcagaacccttagcacacaggaaatggattactctttggatataacaccaccttcaaaaatttctgtttgccatgcagaacttgaattggggacttgttttcaagcagtaaatagcagaattcagttacaaattcttgaggcacggtaccttccaagctcatcaacacctctgactttgagttttttcgtgaaggtgggaatgtttagctcgggagagttgatttataagaaaaagacacgcttactgaaggcctccaatggaagagtcaagtggggagagactatgatttttccacttatacagagtgaaaaagaaattgtttttctcattaagctttacagtcgaagctctgtaagaagaaaacactttgtgggccagatttcatttgaaaggaaggttct

SEQ ID NO: 5565 - DNA, 1193 bp, synthetic construct
  misc_feature 1..1193: note = Synthetic polypeptide
  source 1..1193: mol_type = other DNA
atggcaacagaatttataaagagttgctgtggaggatgtttctatggtgaaacagaaaaacacaacttttctgtggaaagagattttaaagcagcagtcccaaatagtcaaaatgctactatctctgtacctccattgacttctgtttctgtaaagcctcagcttggctgtactgaggattatttgctttccaaattaccatctgatggcaaagaagtaccatttgtggtgcccaagtttaagttatcttacattcaacccaggacacaagaaactccttcacatctggaagaacttgaaggatctgccagagcatcttttggagatcgaaaggtagaactttccagttcatcccagcacggacctagctatgatgtgtataacccattctatatgtatcagcacatttcacctgatttgagtcgacgctttcctccccgttcagaagtgaagagactgtatggatcggtttgtgatttaaggacgaacaaacttcccggttcccctgggctaagcaaatctatgtttgatcttacaaactcatctcagcgattcatccagagacatgattcattgtccagtgtacccagtagttcttcttcaaggaaaaattctcaggggagtaacagaagcctggatacaattactctatcaggagatgaaagggactttgggagactgaatgtgaaattgttttataattcttcagtagaacagatctggatcacagttttacagtgcagagatttaagttggccctctagttatggagacactcctactgtttctataaaaggaatacttacattgcccaaaccagtgcatttcaaatcttcagccaaggaaggttccaacgtttgccatgcagaacttgaattggggacttgttttcaagcagtaaatagcagaattcagttacaaattcttgaggcacggtaccttccaagctcatcaacacctctgactttgagttttttcgtgaaggtgggaatgtttagctcgggagagttgatttataagaaaaagacacgcttactgaaggcctccaatggaagagtcaagtggggagagactatgatttttccacttatacagagtgaaaaagaaattgtttttctcattaagctttacagtcgaagctctgtaagaagaaaacactttgtgggccagatttcatttgaaaggaaggttct

SEQ ID NO: 5566 - DNA, 641 bp, synthetic construct
  misc_feature 1..641: note = Synthetic polypeptide
  source 1..641: mol_type = other DNA
agaagcctggatacaattactctatcaggagatgaaagggactttgggagactgaatgtgaaattgttttataattcttcagtagaacagatctggatcacagttttacaggctattgaatttatggaaacgtttgtatttgctattaaacttcaaaatctacaaactgtaagacttgtatttaagattcaaacccagactcccaggaagaaaaccattggagaatgctcaatgtcactcagaacccttagcacacaggaaatggattactctttggatataacaccaccttcaaaaatttctgtttgccatgcagaacttgaattggggacttgttttcaagcagtaaatagcagaattcagttacaaattcttgaggcacggtaccttccaagctcatcaacacctctgactttgagttttttcgtgaaggtgggaatgtttagctcgggagagttgatttataagaaaaagacacgcttactgaaggcctccaatggaagagtcaagtggggagagactatgatttttccacttatacagagtgaaaaagaaattgtttttctcattaagctttacagtcgaagctctgtaagaagaaaacactttgtgggccagatttcatttgaaaggaaggttct

SEQ ID NO: 5567 - DNA, 350 bp, synthetic construct; identical to SEQ ID NO: 3337
  misc_feature 1..350: note = Synthetic polypeptide
  source 1..350: mol_type = other DNA

SEQ ID NO: 5568 - DNA, 98 bp, synthetic construct
  misc_feature 1..98: note = Synthetic polypeptide
  source 1..98: mol_type = other DNA
atggatgtgaggttctaccccgcggcggccggggaccctgccagcctggacttcgcgcagtgcctggggtactacggctacagcaagttctcttccag

SEQ ID NO: 5569 - DNA, 118 bp, synthetic construct; identical to SEQ ID NO: 162
  misc_feature 1..118: note = Synthetic polypeptide
  source 1..118: mol_type = other DNA

SEQ ID NO: 5570 - DNA, 212 bp, synthetic construct
  misc_feature 1..212: note = Synthetic polypeptide
  source 1..212: mol_type = other DNA
atgaatcctgtttatagtcctggatcttctggggttccctatgcaaatgccaaaggaattggttatccagctcttcggaaggctgaggcaggagaatcgcttgaacctgggaggcagaggttgcagtgagccaagatcatgccattgcactccagcctgggcgatgaaagtgaaactctgtctcaaaagacgacaacgataaaaaaaacaaa

SEQ ID NO: 5571 - DNA, 52 bp, synthetic construct; identical to SEQ ID NO: 4331
  misc_feature 1..52: note = Synthetic polypeptide
  source 1..52: mol_type = other DNA

SEQ ID NO: 5572 - DNA, 237 bp, synthetic construct; identical to SEQ ID NO: 4230
  misc_feature 1..237: note = Synthetic polypeptide
  source 1..237: mol_type = other DNA

SEQ ID NO: 5573 - DNA, 660 bp, synthetic construct; identical to SEQ ID NO: 4231
  misc_feature 1..660: note = Synthetic polypeptide
  source 1..660: mol_type = other DNA

SEQ ID NO: 5574 - DNA, 44 bp, synthetic construct
  misc_feature 1..44: note = Synthetic polypeptide
  source 1..44: mol_type = other DNA
atgttgcacttaactgatattcagttactccagtttattaactg

SEQ ID NO: 5575 - DNA, 353 bp, synthetic construct
  misc_feature 1..353: note = Synthetic polypeptide
  source 1..353: mol_type = other DNA
atggcgacggcggcctacgagcagctgaagctgcatatcacacctgaaaaattttatgtggaagcttgtgatgatggagcagatgacgtacttaccattgaccgtgtgtccacagaggttacccttgcagtcaagaaagatgttcctccttcagctgtcacaagaccaatatttggtatactgggcacaatccatctggtggcaggtaattatcttatagtcattaccaaaaagataaaagtaggtgaatttttcagtcatgtagtctggaaagcaacagattttgatgtcctttcttataagaagacaatgttgcacttaactgatattcagttactccagtttattaactg

SEQ ID NO: 5576 - DNA, 393 bp, synthetic construct; identical to SEQ ID NO: 1400
  misc_feature 1..393: note = Synthetic polypeptide
  source 1..393: mol_type = other DNA

SEQ ID NO: 5577 - DNA, 272 bp, synthetic construct; identical to SEQ ID NO: 1401
  misc_feature 1..272: note = Synthetic polypeptide
  source 1..272: mol_type = other DNA

SEQ ID NO: 5578 - DNA, 2095 bp, synthetic construct; identical to SEQ ID NO: 2095
  misc_feature 1..2095: note = Synthetic polypeptide
  source 1..2095: mol_type = other DNA

SEQ ID NO: 5579 - DNA, 82 bp, synthetic construct
  misc_feature 1..82: note = Synthetic polypeptide
  source 1..82: mol_type = other DNA
atggcggccggcgaaaggagctggtgcctgtgcaagttgttgagtttcgagtatgtctttatcagcagcgtgaaaatgaact

SEQ ID NO: 5580 - DNA, 1838 bp, synthetic construct; identical to SEQ ID NO: 2152
  misc_feature 1..1838: note = Synthetic polypeptide
  source 1..1838: mol_type = other DNA

SEQ ID NO: 5581 - DNA, 842 bp, synthetic construct; identical to SEQ ID NO: 5551
  misc_feature 1..842: note = Synthetic polypeptide
  source 1..842: mol_type = other DNA

SEQ ID NO: 5582 - DNA, 623 bp, synthetic construct; identical to SEQ ID NO: 5552
  misc_feature 1..623: note = Synthetic polypeptide
  source 1..623: mol_type = other DNA

SEQ ID NO: 5583 - DNA, 1421 bp, synthetic construct
  misc_feature 1..1421: note = Synthetic polypeptide
  source 1..1421: mol_type = other DNA
atggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtctgcagcttcactcctgaagccagcgagaccacgaacccaccgggaggaacgaacaactccagatgcgccgccttaagagctgtaacactcaccgcgaaggtccgtggcctcactcctgagcccccaagaccacgaacccaccagaaggaagaaactccaaacacatccgaacatcagaaggaacaaactctggacacgctgactttaagaactgtaacactcaccgcgaaggtctgcggcttcattcttgaagtcagtgagaccaagaacccaccaattccggacaca

SEQ ID NO: 5584 - DNA, 1430 bp, synthetic construct
  misc_feature 1..1430: note = Synthetic polypeptide
  source 1..1430: mol_type = other DNA
atggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaaggtgaaagagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtctgcagcttcactcctgaagccagcgagaccacgaacccaccgggaggaacgaacaactccagatgcgccgccttaagagctgtaacactcaccgcgaaggtccgtggcctcactcctgagcccccaagaccacgaacccaccagaaggaagaaactccaaacacatccgaacatcagaaggaacaaactctggacacgctgactttaagaactgtaacactcaccgcgaaggtctgcggcttcattcttgaagtcagtgagaccaagaacccaccaattccggacaca

SEQ ID NO: 5585 - DNA, 867 bp, synthetic construct
  misc_feature 1..867: note = Synthetic polypeptide
  source 1..867: mol_type = other DNA
gggaagcccagtggaggacaatgagaaggatctggtgaaactggctaaacgcctcaagaaggagaaagtaaatgttgacattatcaattttggggaagaggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtctgcagcttcactcctgaagccagcgagaccacgaacccaccgggaggaacgaacaactccagatgcgccgccttaagagctgtaacactcaccgcgaaggtccgtggcctcactcctgagcccccaagaccacgaacccaccagaaggaagaaactccaaacacatccgaacatcagaaggaacaaactctggacacgctgactttaagaactgtaacactcaccgcgaaggtctgcggcttcattcttgaagtcagtgagaccaagaacccaccaattccggacaca

SEQ ID NO: 5586 - DNA, 541 bp, synthetic construct
  misc_feature 1..541: note = Synthetic polypeptide
  source 1..541: mol_type = other DNA
acattgatgccagctcagctatggacacatctgagccagccaagagctcaattaacagagttctcagcaggcccctctatttggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtctgcagcttcactcctgaagccagcgagaccacgaacccaccgggaggaacgaacaactccagatgcgccgccttaagagctgtaacactcaccgcgaaggtccgtggcctcactcctgagcccccaagaccacgaacccaccagaaggaagaaactccaaacacatccgaacatcagaaggaacaaactctggacacgctgactttaagaactgtaacactcaccgcgaaggtctgcggcttcattcttgaagtcagtgagaccaagaacccaccaattccggacaca

SEQ ID NO: 5587 - DNA, 1685 bp, synthetic construct
  misc_feature 1..1685: note = Synthetic polypeptide
  source 1..1685: mol_type = other DNA
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtggagattgcagtgagcccagatcgcaccactgcactccagtctggcaacagagcaagactccatctcaaaaagaaaagaaaagaa

SEQ ID NO: 5588 - DNA, 1688 bp, synthetic construct
  misc_feature 1..1688: note = Synthetic polypeptide
  source 1..1688: mol_type = other DNA
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtggagattgcagtgagcccagatcgcaccactgcactccagtctggcaacagagcaagactccatctcaaaaagaaaagaaaagaa

SEQ ID NO: 5589 - DNA, 980 bp, synthetic construct; identical to SEQ ID NO: 139
  misc_feature 1..980: note = Synthetic polypeptide
  source 1..980: mol_type = other DNA

SEQ ID NO: 5590 - DNA, 1256 bp, synthetic construct; identical to SEQ ID NO: 140
  misc_feature 1..1256: note = Synthetic polypeptide
  source 1..1256: mol_type = other DNA

SEQ ID NO: 5591 - DNA, 1277 bp, synthetic construct; identical to SEQ ID NO: 142
  misc_feature 1..1277: note = Synthetic polypeptide
  source 1..1277: mol_type = other DNA

SEQ ID NO: 5592 - DNA, 1846 bp, synthetic construct
  misc_feature 1..1846: note = Synthetic polypeptide
  source 1..1846: mol_type = other DNA
atggcggcggccgcggcggcgctctcgggcgcgggcacgccacccgcgggcggcggggccgggggcggcggggccgggggcggcgggtccccgccgggcggctgggccgtggcgcgcctggagggccgcgagttcgagtatctgatgaagaagcgctcggtgaccatcggccgcaactcgtcgcagggctcggtggacgtgagcatgggccactcgagcttcatctcccggcgccacctcgagatcttcacgcccccgggcggcggcggccatggcggggccgctccggagctgccgcccgcgcagcccaggcccgacgccggcggcgacttctacctgcgctgcttgggcaagaacggggtattcgtggacggcgtgttccagaggcgcggggcgccgccgctgcagctgccgcgcgtgtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaaggtgggccgggggggaaaggaggagaggggagaccacagggaggtcaaaggtaggcggaggggaaaggaggagaggggagaccacagggaggtgaaaggtgggcgggggggaaaggaggagaggggagaccacagggaggtcaaaggtgggccggggggggaaaggaggagaggggagaccacagggaggtcaaaggtgggccgggggggaaaggaggagaggggagaccacagggaggtcaaaggtaggcggaggggaaaggaggagagg

SEQ ID NO: 5593 - DNA, 341 bp, synthetic construct
  misc_feature 1..341: note = Synthetic polypeptide
  source 1..341: mol_type = other DNA
caccccggcagccgtgctggcccctcctaaggcagaggcccaggagaatggagaccacagggaagtcaaaggtgggccgggggggaaaggaggagaggggagaccacagggaggtcaaaggtaggcggaggggaaaggaggagaggggagaccacagggaggtgaaaggtgggcgggggggaaaggaggagaggggagaccacagggaggtcaaaggtgggccggggggggaaaggaggagaggggagaccacagggaggtcaaaggtgggccgggggggaaaggaggagaggggagaccacagggaggtcaaaggtaggcggaggggaaaggaggagagg

SEQ ID NO: 5594 - DNA, 1093 bp, synthetic construct; identical to SEQ ID NO: 2131
  misc_feature 1..1093: note = Synthetic polypeptide
  source 1..1093: mol_type = other DNA

SEQ ID NO: 5595 - DNA, 1234 bp, synthetic construct; identical to SEQ ID NO: 2132
  misc_feature 1..1234: note = Synthetic polypeptide
  source 1..1234: mol_type = other DNA

SEQ ID NO: 5596 - DNA, 443 bp, synthetic construct
  misc_feature 1..443: note = Synthetic polypeptide
  source 1..443: mol_type = other DNA
atggaacccgaagaagaaaggattcgttacagccagagattgcgtggtaccatgcgacgacgctatgaagatgatggcatttcagatgatgaaattgaaggaaaaagaacttttgacttggaagagaaactgcacaccaacaaatataatgccaattttgttacttttatggaaggaaaagattttaatgtagagtatattcagcggggtggcttgagagatcctctgattttcaagaattctgatggactcggaataaaaatgccggatccagacttcactgtgaatgatgtcaaaatgtgtgtggcaaaaaggccctcaccagatgctggcgccttgattttagacttcccagcctccagaactgtgagcgaataaatttctgttcatcataaattacctactcaggttttctgtcaacagcaacacaaaatggactaaga

SEQ ID NO: 5597 - DNA, 842 bp, synthetic construct
  misc_feature 1..842: note = Synthetic polypeptide
  source 1..842: mol_type = other DNA
atgaagtggctgctgctgctgggtctggtggcgctctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgcttccaccactcccccgctgtatgaccttgggcaggtggcctcacctccctcaggctcagtgtcctcatggtaagtggaaataacagtgacagtgcccactgcataggcactggcctaagaggaaaagaaaccacattagtcacaccgcaggacagccctagaaagtgcccaatcaagggtagccct

SEQ ID NO: 5598 - DNA, 1257 bp, synthetic construct; identical to SEQ ID NO: 4461
  misc_feature 1..1257: note = Synthetic polypeptide
  source 1..1257: mol_type = other DNA

SEQ ID NO: 5599 - DNA, 1173 bp, synthetic construct; identical to SEQ ID NO: 4462
  misc_feature 1..1173: note = Synthetic polypeptide
  source 1..1173: mol_type = other DNA

SEQ ID NO: 5600 - DNA, 1125 bp, synthetic construct; identical to SEQ ID NO: 4463
  misc_feature 1..1125: note = Synthetic polypeptide
  source 1..1125: mol_type = other DNA

SEQ ID NO: 5601 - DNA, 199 bp, synthetic construct; identical to SEQ ID NO: 2168
  misc_feature 1..199: note = Synthetic polypeptide
  source 1..199: mol_type = other DNA

SEQ ID NO: 5602 - DNA, 2106 bp, synthetic construct
  misc_feature 1..2106: note = Synthetic polypeptide
  source 1..2106: mol_type = other DNA
atggggccgccgctcccgctgctgctgctgctactgctgctgctgccgccacgcgtcctgcctgccgccccttcgtccgtcccccgcggccggcagctcccggggcgtctgggctgcctgctcgaggagggcctctgcggagcgtccgaggcctgtgtgaacggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggtcccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaccccctgcgccccgaggaaggaaggcggctggtggaggacgtcgcccgcctcctgcaggtgcccagcagtgcgttcgctgacgtggacagtatacagacaacccaaagagtgagaaaaaatcttcatgatctatatatccgacaaaagactaatatccagactctacaaagaactcacattagcaagaaacaaacagtcccatcaaacaatgggctaaagacatgaatagacaattcttgaaagaagatatacaaatggccaacaaacatatgaaaaaatgcccaacatcactaatgatcagggaaatgcaaatcgaaaccacaatgttataccaccttactcctgcaagattggatataatcaaaaaatcaaaaaacagtagatgctggtgtggatgtggtgaacagggaacacttctacactgctggtgggagtgcaaactagcacagccactatggaaaacagtgtggagattccttaaagaactaaaagaactaccatttgattcagcaatcccactgctgggtatctacctggaggacaagaagtcattatacgagaaagatatttgcacacacgtttatagcagcacaatttgcaattgcaaaaatatggaaccaacccaaatgcccatcaatcaatgagtagataaagaaatcgtgg

SEQ ID NO: 5603 - DNA, 2169 bp, synthetic construct
  misc_feature 1..2169: note = Synthetic polypeptide
  source 1..2169: mol_type = other DNA
atggggccgccgctcccgctgctgctgctgctactgctgctgctgccgccacgcgtcctgcctgccgccccttcgtccgtcccccgcggccggcagctcccggggcgtctggatggagtgtttggaaggtgccagaaggttccggcaatggacttttaccgctacgaggtgtcgcccgtggccctgcagcgcctgcgcgtggcgttgcagaagctttccggcacaggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggtcccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaccccctgcgccccgaggaaggaaggcggctggtggaggacgtcgcccgcctcctgcaggtgcccagcagtgcgttcgctgacgtggacagtatacagacaacccaaagagtgagaaaaaatcttcatgatctatatatccgacaaaagactaatatccagactctacaaagaactcacattagcaagaaacaaacagtcccatcaaacaatgggctaaagacatgaatagacaattcttgaaagaagatatacaaatggccaacaaacatatgaaaaaatgcccaacatcactaatgatcagggaaatgcaaatcgaaaccacaatgttataccaccttactcctgcaagattggatataatcaaaaaatcaaaaaacagtagatgctggtgtggatgtggtgaacagggaacacttctacactgctggtgggagtgcaaactagcacagccactatggaaaacagtgtggagattccttaaagaactaaaagaactaccatttgattcagcaatcccactgctgggtatctacctggaggacaagaagtcattatacgagaaagatatttgcacacacgtttatagcagcacaatttgcaattgcaaaaatatggaaccaacccaaatgcccatcaatcaatgagtagataaagaaatcgtgg

SEQ ID NO: 5604 - DNA, 2220 bp, synthetic construct
  misc_feature 1..2220: note = Synthetic polypeptide
  source 1..2220: mol_type = other DNA
atggggccgccgctcccgctgctgctgctgctactgctgctgctgccgccacgcgtcctgcctgccgccccttcgtccgtcccccgcggccggcagctcccggggcgtctgggctgcctgctcgaggagggcctctgcggagcgtccgaggcctgtgtgaacgatggagtgtttggaaggtgccagaaggttccggcaatggacttttaccgctacgaggtgtcgcccgtggccctgcagcgcctgcgcgtggcgttgcagaagctttccggcacaggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggtcccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaccccctgcgccccgaggaaggaaggcggctggtggaggacgtcgcccgcctcctgcaggtgcccagcagtgcgttcgctgacgtggacagtatacagacaacccaaagagtgagaaaaaatcttcatgatctatatatccgacaaaagactaatatccagactctacaaagaactcacattagcaagaaacaaacagtcccatcaaacaatgggctaaagacatgaatagacaattcttgaaagaagatatacaaatggccaacaaacatatgaaaaaatgcccaacatcactaatgatcagggaaatgcaaatcgaaaccacaatgttataccaccttactcctgcaagattggatataatcaaaaaatcaaaaaacagtagatgctggtgtggatgtggtgaacagggaacacttctacactgctggtgggagtgcaaactagcacagccactatggaaaacagtgtggagattccttaaagaactaaaagaactaccatttgattcagcaatcccactgctgggtatctacctggaggacaagaagtcattatacgagaaagatatttgcacacacgtttatagcagcacaatttgcaattgcaaaaatatggaaccaacccaaatgcccatcaatcaatgagtagataaagaaatcgtgg

SEQ ID NO: 5605 - DNA, 2289 bp, synthetic construct
  misc_feature 1..2289: note = Synthetic polypeptide
  source 1..2289: mol_type = other DNA
atggctgtggaatctgaatattcactgctgagaaccgaagccagctttcctactatgaagatgttctgtgtgagccacaccttgcccagggtggaagtgatgtttgtttcaggtccacagacgagggagaggacggagccagtggaccctcggtggcagtgtctggtgcagatgtgggcaggctgcctgctcgaggagggcctctgcggagcgtccgaggcctgtgtgaacgatggagtgtttggaaggtgccagaaggttccggcaatggacttttaccgctacgaggtgtcgcccgtggccctgcagcgcctgcgcgtggcgttgcagaagctttccggcacaggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggtcccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaccccctgcgccccgaggaaggaaggcggctggtggaggacgtcgcccgcctcctgcaggtgcccagcagtgcgttcgctgacgtggacagtatacagacaacccaaagagtgagaaaaaatcttcatgatctatatatccgacaaaagactaatatccagactctacaaagaactcacattagcaagaaacaaacagtcccatcaaacaatgggctaaagacatgaatagacaattcttgaaagaagatatacaaatggccaacaaacatatgaaaaaatgcccaacatcactaatgatcagggaaatgcaaatcgaaaccacaatgttataccaccttactcctgcaagattggatataatcaaaaaatcaaaaaacagtagatgctggtgtggatgtggtgaacagggaacacttctacactgctggtgggagtgcaaactagcacagccactatggaaaacagtgtggagattccttaaagaactaaaagaactaccatttgattcagcaatcccactgctgggtatctacctggaggacaagaagtcattatacgagaaagatatttgcacacacgtttatagcagcacaatttgcaattgcaaaaatatggaaccaacccaaatgcccatcaatcaatgagtagataaagaaatcgtgg

SEQ ID NO: 5606 - DNA, 5277 bp, synthetic construct
  misc_feature 1..5277: note = Synthetic polypeptide
  source 1..5277: mol_type = other DNA
atggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgcaaggcccatcttttgcctacggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaagaacgctccagcccaggacttcgaggctgcaatgagctataattgcatcattgcactccagcctgggcaacagagaccctgtctca

SEQ ID NO: 5607 - DNA, 5256 bp, synthetic construct
  misc_feature 1..5256: note = Synthetic polypeptide
  source 1..5256: mol_type = other DNA
atggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaagaacgctccagcccaggacttcgaggctgcaatgagctataattgcatcattgcactccagcctgggcaacagagaccctgtctca

SEQ ID NO: 5608 - DNA, 261 bp, synthetic construct
  misc_feature 1..261: note = Synthetic polypeptide
  source 1..261: mol_type = other DNA
atggtggtgggcgcgttccctatggcgaagctgctatacttgggcatccggcaggtcagcaagccgcttgccaaccgtattaaggaggccgcccgccgaagcgagttcttcaagacctatatctgcctcccgccggctcaacgaactgactgagcgcaagaagacagctccgactccctgtgatttcatctctgaccaatcagcactcctggctcactggcttcccctcacccatcaagttatccttaaaaactctgctcc

SEQ ID NO: 5609 - DNA, 2749 bp, synthetic construct
  misc_feature 1..2749: note = Synthetic polypeptide
  source 1..2749: mol_type = other DNA
atgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgaacactcatgccctttgcctcttacagccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggaggttgcattcaactgagatcataccacttcattccagcctgggtgacagagcaagactctgtctcaaaaaaaaaaaaaaggaaaa

SEQ ID NO: 5610 - DNA, 2722 bp, synthetic construct
  misc_feature 1..2722: note = Synthetic polypeptide
  source 1..2722: mol_type = other DNA
atgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggaggttgcattcaactgagatcataccacttcattccagcctgggtgacagagcaagactctgtctcaaaaaaaaaaaaaaggaaaa

SEQ ID NO: 5611 - DNA, 216 bp, synthetic construct
  misc_feature 1..216: note = Synthetic polypeptide
  source 1..216: mol_type = other DNA
atgaaactgtattgcctgtcagggcacccaaccttaccatgcaatgtgctcaaattcaaatcaaccaccattatgttggactgcggactggacatgacttctaccctcaatttccttcctttgccacttgttcaaagtcccaggctgtccaatcttcctggctggtccctgaaggatggaaatgctttcttggacaagggtcagcctgtgggggaa

SEQ ID NO: 5612 - DNA, 144 bp, synthetic construct
  misc_feature 1..144: note = Synthetic polypeptide
  source 1..144: mol_type = other DNA
atgttggactgcggactggacatgacttctaccctcaatttccttcctttgccacttgttcaaagtcccaggctgtccaatcttcctggctggtccctgaaggatggaaatgctttcttggacaagggtcagcctgtgggggaa

SEQ ID NO: 5613 - DNA, 88 bp, synthetic construct
  misc_feature 1..88: note = Synthetic polypeptide
  source 1..88: mol_type = other DNA
atgaaactgtcccaggctgtccaatcttcctggctggtccctgaaggatggaaatgctttcttggacaagggtcagcctgtgggggaa

SEQ ID NO: 5614 - DNA, 190 bp, synthetic construct
  misc_feature 1..190: note = Synthetic polypeptide
  source 1..190: mol_type = other DNA
cccaaccttaccatgcaatgtgctcaaattcaaatcaaccaccattatgttggactgcggactggacatgacttctaccctcaatttccttcctttgccacttgttcaaagtcccaggctgtccaatcttcctggctggtccctgaaggatggaaatgctttcttggacaagggtcagcctgtgggggaa

SEQ ID NO: 5615 - DNA, 2437 bp, synthetic construct; identical to SEQ ID NO: 1794
  misc_feature 1..2437: note = Synthetic polypeptide
  source 1..2437: mol_type = other DNA

SEQ ID NO: 5616 - DNA, 1224 bp, synthetic construct; identical to SEQ ID NO: 1795
  misc_feature 1..1224: note = Synthetic polypeptide
  source 1..1224: mol_type = other DNA

SEQ ID NO: 5617 - DNA, 95 bp, synthetic construct; identical to SEQ ID NO: 4289
  misc_feature 1..95: note = Synthetic polypeptide
  source 1..95: mol_type = other DNA

SEQ ID NO: 5618 - DNA, 1324 bp, synthetic construct; identical to SEQ ID NO: 326
  misc_feature 1..1324: note = Synthetic polypeptide
  source 1..1324: mol_type = other DNA

SEQ ID NO: 5619 - DNA, 721 bp, synthetic construct; identical to SEQ ID NO: 414
  misc_feature 1..721: note = Synthetic polypeptide
  source 1..721: mol_type = other DNA

SEQ ID NO: 5620 - DNA, 5763 bp, synthetic construct
  misc_feature 1..5763: note = Synthetic polypeptide
  source 1..5763: mol_type = other DNA
atgtgtaaaatggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaaattggcctgcttggacctgtaacaccagtgccagtgtacactgccttggggcccaaggaaatgcatgctcaacccactgctgctatcatggggcctgaagactgacttacctgccaccccaggccctagcaaaacgttaccacagcctccactaataactgcaccataagctactgaggaaatcacagataactggtgctgtgtacagctgaagaaatcttacagagactacactactgcatacatctagaatcatagctaaagtgccctacccaaccaacaccatagatacatgttcaaaacaatgccctcccctgttaaagtaaattcaaaaaattgaaggcagtgactgacaccagatgcccaagtagcaacataaggatgcaggaaacatcaaaaagcaaggaaatatgacatctccaggggaacacaataattcttcagcaatgattccgatcaaaaagaaattcacgaaatcctgaacaaataattcacattcttgattgtgaagaagctcagtgagataccagggaattatgaaaaataatacatagaaatcagaaaaacagtgcaggatatgaatgaaaaatttgccaaagagatagttatcataaaaaagaaccatacagaaatcctgaaactgaagaattcattgaatgaaataaaaaatgttagattcaacaatagtctagattaagcagaagaaggaatctgacaactcaaagacagaagacaggtctttcaaaataacctaatcagacagaaataatgttaaaagaataaaaaagaataattgaagccttcgagacatatgggatactataaagccaccacatatttgaatcatttgggtcccagaagacagagaacaaaaggattggaaaactcatctatttttttgttattaaataatagatgaaaacttcccaaatctatcaaatgatttagatatccagaaacaggaggctccaagatccgcaaacatatacaatgcaagaaagtcttctccttggcacattatagtcaaactatctaaagtcaaagacagaattctgaaaaaggcaagagaaaagtgcctagtcagttgtaaagaaaaccttatcaggctaatagtgaatttctcagcagaaaccttacaagccaggaaagaatgatacattcaaagtactgaatgaaaaaaatgctatccaagggatactatatctagcaaaaatattctttgtaactgaaggagaaataaagtcttccccagaaattgcttaagggagtcctaatcctgggagcaaaatgactacatttaccatcatgaaaacttatgaatgtgtaaaacctgctaataaagcaatcacacaaaggaataagggaaagtaattaaatggtacctgtacggaaaaccaccaaaccaaaattagaaaaaataagtgaaaaagaaaggaatgaagagtatataaaaccagaaaacaataacaatataataggaacaaaacctcacatgttaataataatcttgaatgtggaaggattgaattttccacttagaagctacagcctggcagaatggattaaaaattaagatccagctatatattacctgcaagaaacacactttacctataatggcacatgtagactaaaaataaaggaatggaaaaaattactccacacgaacagaaaccaaaagtgagtaggagtagctatacttatgtcagataaaacagactttaagtcaaacacagtaaaaaaaaaaaaaaaaaaaaaaaaaagacaaggtcattatgcaatgacaaaggaatcaattcagcaacagaatattatggctctaaatatatatgtgtccaacactggagcaacaagattcataggataaatattactagatttaaggagagagactacaatacaataatagtggggaactccaaccccattctcagcatgagacaaatcatttagacagaaagttaacaaacatttataaacttttatttaaactggattttagactacctggactcaacagatatttacagaacattttatccaaaaactacagaatataaagtcttctcatcagcacatggaatattctccagaatagactgttaggccacaaaataggtaacaacaattttttaaaacgcaagatcatatcaactatgtcctcagaacacaatggaataaaactagaaatatcaagaggatctttggaaactatacggatgtatggaattaaacaacatgttcctgaatgacgattagatcaattaagaaattaagaaggaagttaaaaaatttcttgaaacgaatgaaagtggaaacacaacataccaaaacctgtgggatacagcaaaagcagtactaacatgaagtttatagcaataaatgcccacatcaaaacagtagagtttaaataaacaatctaatgatgcacctcaagaaactagaaaagcaagaacaaaacaaatccaagattaggagaaagaaagaaataatgtagatcagggcagagataagcaaaatagagactaaagtaacagttcaaaggatcagttaaacgaaaagttgattctttgaaaagacacaaaattgataaatcactagcttgactaaccaagaaaaggagagatgacccacataaatcagaaataaaaaagaaattacatctgataccacagaaatacaaaggttcatcagagactatcatgaacagctacacactaacagactggaaaatctagaggaaatggataatttcctggacacctaccatctaccaagcttgaatctggaaaaaacagaaagcctgaacaaaccaataaccagtaacaaagtcatatcagtaataaaaagtctctcagcaaagaaagggctaggagcagattgattcttggccgaattctaccatatgtataaagaagaactgatactaatcctcttgaaactattccaaaaaattgaagagaaaggaattctccctaactcattctatgagggcagcatcacccttataccaaaaccagacaaggacacacaaaaaaagaaaagtacaggtcattattcttgatgaatatggattcaaaaatcctcgacagaatactggcaaactgattcctactgcacattgaaaagataatacaccacaatcaagtgggctttataccagggctacaaggatggttcaacatatgcaaattaacaaatgtgatacatcacgtaagcagaatgaatgataaaaaacatacgatcatctcaatagttgtagaaaaagcatttgataaaattcagcatcccttcatgataaaaaactctcagcaaatatggcatagaagaaacatacctcaaaatcataaaggacatatatggcaaactcacagctaacatcatactgaatggggaaaagttgaaagtctttgctttaggaacagaaacaataccaggatgcccattttcaccactcctattctacatggcactggaaatcctagcaaatcacacaagattaaaaaataaaatgcatttaaattggtagaaaggaagtcagactgtttacctttgagatgacgtgatcttattagaaaaaaacaagactaccacaaaaaactcttagaactgataaacaaattcagccaagttgcagaatacaaaatgaacatgtaaaaatcagtagtgttcctatacaagtataatgaaatagccaccaaagatatcaagaaggcaattctatttacactagctattaaaaaaacataggaataaatttaaccaaggaggtaaagatttcgacaaagcaaactacaaaagatggatgaacgaaatagaagacaaacaaatgaaaagatatcccatgctcatgaatcaaaagaatttatagcatttgtcaattttggcttttgttgccattgcttttggtgttttagacatgaagtccttgcccatgcgtatgtcctgaatggtattgcctaggttttcttctagggtttttatggctttaggtctaacatttaagtctttaatccatcttgaattaatttttgtataaggtgtaaggaagggatccagtttcagctttctacatacagctagccagttttcccagcaccatttattaaatagggaatcctttccccattgcttatttttgtcaggtttgtcaaagatcagatagttgtagatatgtggcattatttctgagggctctgttctgttccattggtctatatctctgttttggtaccagtaccatgctgttttggttactgtagccttgtagtacagtttgaagtcaggtagcgtgatgcctccagcattattcttttggcttaggattggcttggcaatgtgggctctcttttggttccatatgaactttaaagtagtttttttccaattctgtgaagaaagtcattggtagcttgatggggatggcattgaatctataaattaccttgggcagtatggccattttcacgatattgattcttcctacccatgagcatggaaagttcttccatttgtatgggatctaattaatctaaagagcttctgcacagcaaaagaaactaccatcagagtgaacaggcaacctacagaatgggagaaaatttttgcaatctacgcatctgacaaagggctaatatccagaatctacaaagaactcagacaaatttagaagaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacagtgagataccatctcacaccagttagaatggcaatcattaaaaagtcaggaaacaacaggtgctggagaggatgtggagaaataggaacacttttacactgttggtgggactgtgaactagttcaaccattgtggaagtcagtgtggcgatccctcagggatctagaattagaaataccatttgacccagccatcccattactgggtatatacccaaagaattataaatcatgctgctataaagacacatgcacacgtatgtttattgcagcactattcacaatagcaaagacttggaaccaacccaaatgtccaacaatgatagactggattaagaaaatgtggcacatatacaccatggaaaactatgtagccataaaaaatgatgagttcatgtcctttgtaggaacatggatgaagatggaaaccatcattctcagcaaactttcgcaaggacaaaaaccaaacatcgcgtgttctcactcataggtgggaattgaacaatgagaacacttggacacaggaagaggaacatcacacaccagggcctgttgtggggagggatagcattaggaggtatgcctaatgttaaatgacgagttaacgggtgcagcacaccaacatggcacatgtatacatatgtaacaaacctgcacattgtgcacatgtaccctaaaacttaaagtataatttaaaaaa

SEQ ID NO: 5621 - DNA, 5853 bp, synthetic construct
  misc_feature 1..5853: note = Synthetic polypeptide
  source 1..5853: mol_type = other DNA
atggcacacgcaccggcacgctgccccagcgcccggggctccggggacggcgagatgggcaagcccaggaacgtggcgctcatcaccggtatcacaggccaggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaaattggcctgcttggacctgtaacaccagtgccagtgtacactgccttggggcccaaggaaatgcatgctcaacccactgctgctatcatggggcctgaagactgacttacctgccaccccaggccctagcaaaacgttaccacagcctccactaataactgcaccataagctactgaggaaatcacagataactggtgctgtgtacagctgaagaaatcttacagagactacactactgcatacatctagaatcatagctaaagtgccctacccaaccaacaccatagatacatgttcaaaacaatgccctcccctgttaaagtaaattcaaaaaattgaaggcagtgactgacaccagatgcccaagtagcaacataaggatgcaggaaacatcaaaaagcaaggaaatatgacatctccaggggaacacaataattcttcagcaatgattccgatcaaaaagaaattcacgaaatcctgaacaaataattcacattcttgattgtgaagaagctcagtgagataccagggaattatgaaaaataatacatagaaatcagaaaaacagtgcaggatatgaatgaaaaatttgccaaagagatagttatcataaaaaagaaccatacagaaatcctgaaactgaagaattcattgaatgaaataaaaaatgttagattcaacaatagtctagattaagcagaagaaggaatctgacaactcaaagacagaagacaggtctttcaaaataacctaatcagacagaaataatgttaaaagaataaaaaagaataattgaagccttcgagacatatgggatactataaagccaccacatatttgaatcatttgggtcccagaagacagagaacaaaaggattggaaaactcatctatttttttgttattaaataatagatgaaaacttcccaaatctatcaaatgatttagatatccagaaacaggaggctccaagatccgcaaacatatacaatgcaagaaagtcttctccttggcacattatagtcaaactatctaaagtcaaagacagaattctgaaaaaggcaagagaaaagtgcctagtcagttgtaaagaaaaccttatcaggctaatagtgaatttctcagcagaaaccttacaagccaggaaagaatgatacattcaaagtactgaatgaaaaaaatgctatccaagggatactatatctagcaaaaatattctttgtaactgaaggagaaataaagtcttccccagaaattgcttaagggagtcctaatcctgggagcaaaatgactacatttaccatcatgaaaacttatgaatgtgtaaaacctgctaataaagcaatcacacaaaggaataagggaaagtaattaaatggtacctgtacggaaaaccaccaaaccaaaattagaaaaaataagtgaaaaagaaaggaatgaagagtatataaaaccagaaaacaataacaatataataggaacaaaacctcacatgttaataataatcttgaatgtggaaggattgaattttccacttagaagctacagcctggcagaatggattaaaaattaagatccagctatatattacctgcaagaaacacactttacctataatggcacatgtagactaaaaataaaggaatggaaaaaattactccacacgaacagaaaccaaaagtgagtaggagtagctatacttatgtcagataaaacagactttaagtcaaacacagtaaaaaaaaaaaaaaaaaaaaaaaaaagacaaggtcattatgcaatgacaaaggaatcaattcagcaacagaatattatggctctaaatatatatgtgtccaacactggagcaacaagattcataggataaatattactagatttaaggagagagactacaatacaataatagtggggaactccaaccccattctcagcatgagacaaatcatttagacagaaagttaacaaacatttataaacttttatttaaactggattttagactacctggactcaacagatatttacagaacattttatccaaaaactacagaatataaagtcttctcatcagcacatggaatattctccagaatagactgttaggccacaaaataggtaacaacaattttttaaaacgcaagatcatatcaactatgtcctcagaacacaatggaataaaactagaaatatcaagaggatctttggaaactatacggatgtatggaattaaacaacatgttcctgaatgacgattagatcaattaagaaattaagaaggaagttaaaaaatttcttgaaacgaatgaaagtggaaacacaacataccaaaacctgtgggatacagcaaaagcagtactaacatgaagtttatagcaataaatgcccacatcaaaacagtagagtttaaataaacaatctaatgatgcacctcaagaaactagaaaagcaagaacaaaacaaatccaagattaggagaaagaaagaaataatgtagatcagggcagagataagcaaaatagagactaaagtaacagttcaaaggatcagttaaacgaaaagttgattctttgaaaagacacaaaattgataaatcactagcttgactaaccaagaaaaggagagatgacccacataaatcagaaataaaaaagaaattacatctgataccacagaaatacaaaggttcatcagagactatcatgaacagctacacactaacagactggaaaatctagaggaaatggataatttcctggacacctaccatctaccaagcttgaatctggaaaaaacagaaagcctgaacaaaccaataaccagtaacaaagtcatatcagtaataaaaagtctctcagcaaagaaagggctaggagcagattgattcttggccgaattctaccatatgtataaagaagaactgatactaatcctcttgaaactattccaaaaaattgaagagaaaggaattctccctaactcattctatgagggcagcatcacccttataccaaaaccagacaaggacacacaaaaaaagaaaagtacaggtcattattcttgatgaatatggattcaaaaatcctcgacagaatactggcaaactgattcctactgcacattgaaaagataatacaccacaatcaagtgggctttataccagggctacaaggatggttcaacatatgcaaattaacaaatgtgatacatcacgtaagcagaatgaatgataaaaaacatacgatcatctcaatagttgtagaaaaagcatttgataaaattcagcatcccttcatgataaaaaactctcagcaaatatggcatagaagaaacatacctcaaaatcataaaggacatatatggcaaactcacagctaacatcatactgaatggggaaaagttgaaagtctttgctttaggaacagaaacaataccaggatgcccattttcaccactcctattctacatggcactggaaatcctagcaaatcacacaagattaaaaaataaaatgcatttaaattggtagaaaggaagtcagactgtttacctttgagatgacgtgatcttattagaaaaaaacaagactaccacaaaaaactcttagaactgataaacaaattcagccaagttgcagaatacaaaatgaacatgtaaaaatcagtagtgttcctatacaagtataatgaaatagccaccaaagatatcaagaaggcaattctatttacactagctattaaaaaaacataggaataaatttaaccaaggaggtaaagatttcgacaaagcaaactacaaaagatggatgaacgaaatagaagacaaacaaatgaaaagatatcccatgctcatgaatcaaaagaatttatagcatttgtcaattttggcttttgttgccattgcttttggtgttttagacatgaagtccttgcccatgcgtatgtcctgaatggtattgcctaggttttcttctagggtttttatggctttaggtctaacatttaagtctttaatccatcttgaattaatttttgtataaggtgtaaggaagggatccagtttcagctttctacatacagctagccagttttcccagcaccatttattaaatagggaatcctttccccattgcttatttttgtcaggtttgtcaaagatcagatagttgtagatatgtggcattatttctgagggctctgttctgttccattggtctatatctctgttttggtaccagtaccatgctgttttggttactgtagccttgtagtacagtttgaagtcaggtagcgtgatgcctccagcattattcttttggcttaggattggcttggcaatgtgggctctcttttggttccatatgaactttaaagtagtttttttccaattctgtgaagaaagtcattggtagcttgatggggatggcattgaatctataaattaccttgggcagtatggccattttcacgatattgattcttcctacccatgagcatggaaagttcttccatttgtatgggatctaattaatctaaagagcttctgcacagcaaaagaaactaccatcagagtgaacaggcaacctacagaatgggagaaaatttttgcaatctacgcatctgacaaagggctaatatccagaatctacaaagaactcagacaaatttagaagaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacagtgagataccatctcacaccagttagaatggcaatcattaaaaagtcaggaaacaacaggtgctggagaggatgtggagaaataggaacacttttacactgttggtgggactgtgaactagttcaaccattgtggaagtcagtgtggcgatccctcagggatctagaattagaaataccatttgacccagccatcccattactgggtatatacccaaagaattataaatcatgctgctataaagacacatgcacacgtatgtttattgcagcactattcacaatagcaaagacttggaaccaacccaaatgtccaacaatgatagactggattaagaaaatgtggcacatatacaccatggaaaactatgtagccataaaaaatgatgagttcatgtcctttgtaggaacatggatgaagatggaaaccatcattctcagcaaactttcgcaaggacaaaaaccaaacatcgcgtgttctcactcataggtgggaattgaacaatgagaacacttggacacaggaagaggaacatcacacaccagggcctgttgtggggagggatagcattaggaggtatgcctaatgttaaatgacgagttaacgggtgcagcacaccaacatggcacatgtatacatatgtaacaaacctgcacattgtgcacatgtaccctaaaacttaaagtataatttaaaaaa

SEQ ID NO: 5622 - DNA, 1726 bp, synthetic construct; identical to SEQ ID NO: 1284
  misc_feature 1..1726: note = Synthetic polypeptide
  source 1..1726: mol_type = other DNA

SEQ ID NO: 5623 - DNA, 807 bp, synthetic construct; identical to SEQ ID NO: 1285
  misc_feature 1..807: note = Synthetic polypeptide
  source 1..807: mol_type = other DNA

SEQ ID NO: 5624 - DNA, 992 bp, synthetic construct; identical to SEQ ID NO: 1286
  misc_feature 1..992: note = Synthetic polypeptide
  source 1..992: mol_type = other DNA

SEQ ID NO: 5625 - DNA, 1326 bp, synthetic construct
  misc_feature 1..1326: note = Synthetic polypeptide
  source 1..1326: mol_type = other DNA
atgggccgaggggtgcgcgtgctgctgctgctgagcctgctgcactgcgccgggggcagcgagggcaggaagacctggcggcgccggggtcagcagccgcctcctcccccgcggaccgaggcggcgccggcggccggacagcccgtggagagcttcccgctggacttcacggccgtggagggtaacatggacagcttcatggcgcaagtcaagagcctggcgcagtccctgtacccctgctccgcgcagcagctcaacgaggacctgcgcctgcacctcctactcaacacctcggtgacctgcaacgacggcagccccgccggctactacctgaaggagtccaggggcagccggcggtggctcctcttcctggaaggcggctggtactgcttcaaccgcgagaactgcgactccagatacgacaccatgcggcgcctcatgagctcccgggactggccgcgcactcgcacaggcacagggatcctgtcctcacagccggaggagaacccctactggtggaacgcaaacatggtcttcatcccctactgctccagtgatgtttggagcggggcttcatccaagtctgagaagaacgagtacgccttcatgggcgccctcatcatccaggaggtggtgcgggagcttctgggcagagggctgagcggggccaaggtgctgctgctggccgggagcagcgcggggggcaccggggtgctcctgaatgtggaccgtgtggctgagcagctggagaagctgggctacccagccatccaggtgcgaggcctggctgactccggctggttcctggacaacaagcagtatcgccacacagactgcgtcgacacgatcacgtgcgcgcccacggaggccatccgccgtggcatcaggtactggaacggggtggtcccggagcgctgccgacgccagttccaggagggcgaggagtggaactgcttctttggctacaaggtctacccgaccctgcgctgccctgtgttcgtggtgcagtggctgtttgacgaggcacagctgacggtggacaacgtgcacctgacggggcagccggtgcaggagggcctgcggctgtacatccagaacctcggccgcgagctgcgccacacactcaaggacgtgccggccagctttgcccccgcctgcctctcccatgagatcatcatccggagctactccggaggctgaggcaggagaatcgcttgaacctgggagacagaggttatggtgagtcgagattgcaacattgcactccatcctgggggcaacaagagtgaaactccatctcaaaaaaaaaagaaaaaaaaaaaaaga

SEQ ID NO: 5626 - DNA, 1889 bp, synthetic construct
  misc_feature 1..1889: note = Synthetic polypeptide
  source 1..1889: mol_type = other DNA
atggcctatgtccccgcaccgggctaccagcccacctacaacccgacgctgccttactaccagcccatcccgggcgggctcaacgtgggaatgtctgtttacatccaaggagtggccagcgagcacatgaagcggttcttcgtgaactttgtggttgggcaggatccgggctcagacgtcgccttccacttcaatccgcggtttgacggctgggacaaggtggtcttcaacacgttgcagggcgggaagtggggcagcgaggagaggaagaggagcatgcccttcaaaaagggtgccgcctttgagctggtcttcatagtcctggctgagcactacaaggtggtggtaaatggaaatcccttctatgagtacgggcaccggcttcccctacagatggtcacccacctgcaagtggatggggatctgcaacttcaatcaatcaacttcatcggaggccagcccctccggccccagggacccccgatgatgccaccttaccctggtcccggacattgccatcaacagctgaacagcctgcccaccatggaaggacccccaaccttcaacccgccgcctgccttggcctcccaaagtgccaagagtgcagcctctgcccggccgctaccccgtctgggaagtgaggtgcgtctctgcctggccgcccatcatctgggacgtgaggagtccctctgcctggctgcccagtctggaaagtgaggagcgtctctgcccggccgccatctcacctaggaagtgaggagcacctcttcccggccaccatcccatctaggaagtgaggagcgtctctgcccggccgcccatcgtctgagatgtggggagcgcctctgccccgccgccccgtctgggaggtgaggagcgtctctgcccggccgccccgtctgagaagggaggagaccctccgcctggcaaccgccccatctgagaagtgaggagcccctccgcccggctgccaccctgtctgggaagtgaggagcgtctccgcccggcagccaccccgtccggaagggaggtgggggggtcagccccccgcccggccagccgccccggccagccaccccgtctgggaggtgaggggcgcctctgcccggccgcccctactgggaagtgaggagcccctctgcccggccagccgccccgtccgggagggaggtgggggagtcagccccctgcccagccagccgccccgtccgggagggaggtgggggggtcagccccccgccaggcgagacgccccgtccgggagggaggtggggggtcagccccctgcccggccagccgcccggtccgggaggtgaggggcgcctctgcccggccgcccctactgggaagtgaggagcccctctgcccggccaccaccccgtctgggaggtgtacccaacagctcattgagaacgggccatgatgacaatggcagttttgcggaatagaaaagggggaaaggtggggaaaagattgagaaatcggatggttgctgtgtctgtgtagaaagaagtagacatgggagacttttcattttgttctgtactaagaaaaattcttctgccttgggatcctgttgatctatgaccttacccccaaccctgtgctctctgaaacatgtgctgtgtccactcagggttaaatggattaagggcggtgcaagatgtgctttgttaaacagatgcttgaaggcagcatgctcgttaagagtcatcaccattccctaatctcaagtacccagggacacacacactctgcctaggaaaaccagagacctttgttcacttgtttatctgctgaccttccctccactattgtcctgtgaccctgccaaatcccccctctgcgagaaacacccaagaatgatcaataaaaaaaaaatacaaaaa

SEQ ID NO: 5627 - DNA, 1573 bp, synthetic construct
  misc_feature 1..1573: note = Synthetic polypeptide
  source 1..1573: mol_type = other DNA
tgcccttcaaaaagggtgccgcctttgagctggtcttcatagtcctggctgagcactacaaggtggtggtaaatggaaatcccttctatgagtacgggcaccggcttcccctacagatggtcacccacctgcaagtggatggggatctgcaacttcaatcaatcaacttcatcggaggccagcccctccggccccagggacccccgatgatgccaccttaccctaccatggaaggacccccaaccttcaacccgccgcctgccttggcctcccaaagtgccaagagtgcagcctctgcccggccgctaccccgtctgggaagtgaggtgcgtctctgcctggccgcccatcatctgggacgtgaggagtccctctgcctggctgcccagtctggaaagtgaggagcgtctctgcccggccgccatctcacctaggaagtgaggagcacctcttcccggccaccatcccatctaggaagtgaggagcgtctctgcccggccgcccatcgtctgagatgtggggagcgcctctgccccgccgccccgtctgggaggtgaggagcgtctctgcccggccgccccgtctgagaagggaggagaccctccgcctggcaaccgccccatctgagaagtgaggagcccctccgcccggctgccaccctgtctgggaagtgaggagcgtctccgcccggcagccaccccgtccggaagggaggtgggggggtcagccccccgcccggccagccgccccggccagccaccccgtctgggaggtgaggggcgcctctgcccggccgcccctactgggaagtgaggagcccctctgcccggccagccgccccgtccgggagggaggtgggggagtcagccccctgcccagccagccgccccgtccgggagggaggtgggggggtcagccccccgccaggcgagacgccccgtccgggagggaggtggggggtcagccccctgcccggccagccgcccggtccgggaggtgaggggcgcctctgcccggccgcccctactgggaagtgaggagcccctctgcccggccaccaccccgtctgggaggtgtacccaacagctcattgagaacgggccatgatgacaatggcagttttgcggaatagaaaagggggaaaggtggggaaaagattgagaaatcggatggttgctgtgtctgtgtagaaagaagtagacatgggagacttttcattttgttctgtactaagaaaaattcttctgccttgggatcctgttgatctatgaccttacccccaaccctgtgctctctgaaacatgtgctgtgtccactcagggttaaatggattaagggcggtgcaagatgtgctttgttaaacagatgcttgaaggcagcatgctcgttaagagtcatcaccattccctaatctcaagtacccagggacacacacactctgcctaggaaaaccagagacctttgttcacttgtttatctgctgaccttccctccactattgtcctgtgaccctgccaaatcccccctctgcgagaaacacccaagaatgatcaataaaaaaaaaatacaaaaa

SEQ ID NO: 5628 - DNA, 3332 bp, synthetic construct
  misc_feature 1..3332: note = Synthetic polypeptide
  source 1..3332: mol_type = other DNA
atgttcagctttgtggacctccggctcctgctcctcttagcggccaccgccctcctgacgcacggccaagaggaaggccaagtcgagggccaagacgaagacatcccaccaatcacctgcgtacagaacggcctcaggtaccatgaccgagacgtgtggaaacccgagccctgccggatctgcgtctgcgacaacggcaaggtgttgtgcgatgacgtgatctgtgacgagaccaagaactgccccggcgccgaagtccccgagggcgagtgctgtcccgtctgccccgacggctcagagtcacccaccgaccaagaaaccaccggcgtcgagggacccaagggagacactggcccccgaggcccaaggggacccgcaggcccccctggccgagatggcatccctggacagcctggacttcccggaccccccggaccccccggacctcccggaccccctggcctcggaggaaactttgctccccagctgtcttatggctatgatgagaaatcaaccggaggaatttccgtgcctggccccatgggtccctctggtcctcgtggtctccctggcccccctggtgcacctggtccccaaggcttccaaggtccccctggtgagcctggcgagcctggagcttcaggtcccatgggtccccgaggtcccccaggtccccctggaaagaatggagatgatggggaagctggaaaacctggtcgtcctggtgagcgtgggcctcctgggcctcagggtgctcgaggattgcccggaacagctggcctccctggaatgaagggacacagaggtttcagtggtttggatggtgccaagggagatgctggtcctgctggtcctaagggtgagcctggcagccctggtgaaaatggagctcctggtcagatgggcccccgtggcctgcctggtgagagaggtcgccctggagcccctggccctgctggtgctcgtggaaatgatggtgctactggtgctgccgggccccctggtcccaccggccccgctggtcctcctggcttccctggtgctgttggtgctaagggtgaagctggtccccaagggccccgaggctctgaaggtccccagggtgtgcgtggtgagcctggcccccctggccctgctggtgctgctggccctgctggaaaccctggtgctgatggacagcctggtgctaaaggtgccaatggtgctcctggtattgctggtgctcctggcttccctggtgcccgaggcccctctggaccccagggccccggcggccctcctggtcccaagggtaacagcggtgaacctggtgctcctggcagcaaaggagacactggtgctaagggagagcctggccctgttggtgttcaaggaccccctggccctgctggagaggaaggaaagcgaggagctcgaggtgaacccggacccactggcctgcccggaccccctggcgagcgtggtggacctggtagccgtggtttccctggcgcagatggtgttgctggtcccaagggtcccgctggtgaacgtggttctcctggccctgctggccccaaaggatctcctggtgaagctggtcgtcccggtgaagctggtctgcctggtgccaagggtctgactggaagccctggcagccctggtcctgatggcaaaactggcccccctggtcccgccggtcaagatggtcgccccggacccccaggcccacctggtgcccgtggtcaggctggtgtgatgggattccctggacctaaaggtgctgctggagagcccggcaaggctggagagcgaggtgttcccggaccccctggcgctgtcggtcctgctggcaaagatggagaggctggagctcagggaccccctggccctgctggtcccgctggcgagagaggtgaacaaggccctgctggctcccccggattccagggtctccctggtcctgctggtcctccaggtgaagcaggcaaacctggtgaacagggtgttcctggagaccttggcgcccctggcccctctggagcaagaggcgagagaggtttccctggcgagcgtggtgtgcaaggtccccctggtcctgctggtccccgaggggccaacggtgctcccggcaacgatggtgctaagggtgatgctggtgcccctggagctcccggtagccagggcgcccctggccttcagggaatgcctggtgaacgtggtgcagctggtcttccagggcctaagggtgacagaggtgatgctggtcccaaaggtgctgatggctctcctggcaaagatggcgtccgtggtctgactggccccattggtcctcctggccctgctggtgcccctggtgacaagggtgaaagtggtcccagcggccctgctggtcccactggagctcgtggtgcccccggagaccgtggtgagcctggtccccccggccctgctggctttgctggcccccctggtgctgacggccaacctggtgctaaaggcgaacctggtgatgctggtgctaaaggcgatgctggtccccctggccctgccggacccgctggaccccctggccccattggtaatgttggtgctcctggagccaaaggtgctcgcggcagcgctggtccccctggtgctactggtttccctggtgctgctggccgagtcggtcctcctggcccctctggaaatgctggaccccctggccctcctggtcctgctggcaaagaaggcggcaaaggtccccgtggtgagactggccctgctggacgtcctggtgaagttggtccccctggtccccctggccctgctggcgagaaaggatcccctggtgctgatggtcctgctggtgctcctggtactcccgggcctcaaggtattgctggacagcgtggtgtggtcggcctgcctggtcagagaggagagagaggcttccctggtcttcctggcccctctggtgaacctggcaaacaaggtccctctggagcaagtggtgaacgtggtccccctggtcccatgggcccccctggattggctggaccccctggtgaatctggacgcacgggggctcacacctgtaatcccagcactttgggaggccgaggtgggtagatcacgagatcaggagttccagaccagcctggccaacatggtgaaaccccatctctactaaaaataattagctgggcgtcgtggtgggcacctgtaatcccagctaatcaggaggctgaggcaggagaatctcttgaacccgggaggcagaggttgcagtgagttgagatcacgccattgcactccagcctgggtgacagagcgagactccgtctcaaaaaaaaaaatttaaaaaagaa

SEQ ID NO: 5629 - DNA, 610 bp, synthetic construct; identical to SEQ ID NO: 163
  misc_feature 1..610: note = Synthetic polypeptide
  source 1..610: mol_type = other DNA

SEQ ID NO: 5630 - DNA, 4988 bp, synthetic construct
  misc_feature 1..4988: note = Synthetic polypeptide
  source 1..4988: mol_type = other DNA
atgtctcgatcccgccatgcaaggccttccagattagtcaggaaggaagatgtaaacaaaaaaaagaaaaacagccaactacgaaagacaaccaagggagccaacaaaaatgtggcatcagtcaagactttaagccctggaaaattaaagcaattaattcaagaaagagatgttaagaaaaaaacagaacctaaaccacccgtgccagtcagaagccttctgacaagagctggagcagcacgcatgaatttggataggactgaggttctttttcagaacccagagtccttaacctgcaatgggtttacaatggcgctacgaagcacctctcttagcaggcgactctcccaacccccactggtcgtagccaaatccaaaaaggttccactttctaagggtttagaaaagcaacatgattgtgattataagatactccctgctttgggagtaaagcactcagaaaatgattcggttccaatgcaagacacccaagtccttcctgatatagagactctaattggtgtacaaaatccctctttacttaaaggtaagagccaagagacaactcagttttggtcccaaagagttgaggattccaagatcaatatccctacccacagtggccctgcagctgagatccttcctgggccactggaagggacacgctgtggtgaaggactattctctgaagagacattgaatgataccagtggttccccaaaaatgtttgctcaggacacagtgtgtgctccttttccccaaagagcaacccccaaagttacctctcaaggaaaccccagcattcagttagaagagttgggttcacgagtagaatctcttaagttatctgattcttacctggatcccattaaaagtgaacatgattgctaccccacctccagtcttaataaggttatacctgacttgaaccttagaaactgcttggctcttggtgggtctacgtctcctacctctgtaataaaattcctcttggcaggctcaaaacaagcgacccttggtgctaaaccagatcatcaagaggccttcgaagctactgcaaatcaacaggaagtttctgataccacctctttcctaggacaggcctttggtgctatcccacatcaatgggaacttcctggtgctgacccagttcatggtgaggccctgggtgagaccccagatctaccagagattcctggtgctattccagtccaaggagaggtctttggtactattttagaccaacaagaaactcttggtatgagtgggagtgttgtcccagacttgcctgtcttccttcctgttcctccaaatccaattgctacctttaatgctccttccaaatggcctgagccccaaagcactgtctcatatggacttgcagtccagggtgctatacagattttgcctttgggctcaggacacactcctcaatcatcatcaaactcagagaaaaattcattacctccagtaatggctataagcaatgtagaaaatgagaagcaggttcatataagcttcctgccagctaacactcaggggttcccattagcccctgagagaggactcttccatgcttcactgggtatagcccaactctctcaggctggtcctagcaaatcagacagagggagctcccaggtcagtgtaaccagcacagttcatgttgtcaacaccacagtggtgactatgccagtgccaatggtcagtacctcctcttcttcctataccactttgctaccgactttggaaaagaagaaaagaaagcgatgtggggtctgtgaaccctgccagcagaagaccaactgtggtgaatgcacttactgcaagaacagaaagaacagccatcagatctgtaagaaaagaaaatgtgaggagctgaaaaagaaaccatctgttgttgtgcctctggaggttataaaggaaaacaagaggccccagagggaaaagaagcccaaagttttaaaggcagattttgacaacaaaccagtaaatggccccaagtcagaatccatggactacagtagatgtggtcatggggaagaacaaaaattggaattgaacccacatactgttgaaaatgtaactaaaaatgaagacagcatgacaggcatcgaggtggagaagtggacacaaaacaagaaatcacagttaactgatcacgtgaaaggagattttagtgctaatgtcccagaagctgaaaaatcgaaaaactctgaagttgacaagaaacgaaccaaatctccaaaattgtttgtacaaaccgtaagaaatggcattaaacatgtacactgtttaccagctgaaacaaatgtttcatttaaaaaattcaatattgaagaattcggcaagacattggaaaacaattcttataaattcctaaaagacactgcaaaccataaaaacgctatgagctctgttgctactgatatgagttgtgatcatctcaaggggagaagtaacgttttagtattccagcagcctggctttaactgcagttccattccacattcttcacactccatcataaatcatcatgctagtatacacaatgaaggtgatcaaccaaaaactcctgagaatataccaagtaaagaaccaaaagatggatctcccgttcaaccaagtctcttatcgttaatgaaagataggagattaacattggagcaagtggtagccatagaggccctgactcaactctcagaagccccatcagagaattcctccccatcaaagtcagagaaggatgaggaatcagagcagagaacagccagtttgcttaatagctgcaaagctatcctctacactgtaagaaaagacctccaagacccaaacttacagggagagccaccaaaacttaatcactgtccatctttggaaaaacaaagttcatgcaacacggtggttttcaatgggcaaactactaccctttccaactcacatatcaactcagctactaaccaagcatccacaaagtcacatgaatattcaaaagtcacaaattcattatctctttttataccaaaatcaaattcatccaagattgacaccaataaaagtattgctcaagggataattactcttgacaattgttccaatgatttgcatcagttgccaccaagaaataatgaagtggagtattgcaaccagttactggacagcagcaaaaaattggactcagatgatctatcatgtcaggatgcaacccatacccaaattgaggaagatgttgcaacacagttgacacaacttgcttcgataattaagatcaattatataaaaccagaggacaaaaaagttgaaagtacaccaacaagccttgtcacatgtaatgtacagcaaaaatacaatcaggagaagggcacaatacaacagaaaccaccttcaagtgtacacaataatcatggttcatcattaacaaaacaaaagaacccaacccagaaaaagacaaaatccaccccatcaagagatcggcggaaaaagaagcccacagttgtaagttatcaagaaaatgatcggcagaagtgggaaaagttgtcctatatgtatggcacaatatgcgacatttggatagcatcgaaatttcaaaattttgggcaattttgtccacatgattttcctactgtatttgggaaaatttcttcctcgaccaaaatatggaaaccactggctcaaacgaggtccattatgcaacccaaaacagtatttccaccactcactcagataaaattacagagatatcctgaatcagcagaggaaaaggtgaaggttgaaccattggattcactcagcttatttcatcttaaaacggaatccaacgggaaggcattcactgataaagcttataattctcaggtacagttaacggtgaatgccaatcagaaagcccatcctttgacccagccctcctctccacctaaccagtgtgctaacgtgatggcaggcgatgaccaaatacggtttcagcaggttgttaaggagcaactcatgcatcagagactgccaacattgcctggtatctctcatgaaacacccttaccggagtcagcactaactctcaggaatgtaaatgtagtgtgttcaggtggaattacagtggtttctaccaaaagtgaagaggaagtctgttcatccagttttggaacatcagaattttccacagtggacagtgcacagaaaaattttaatgattatgccatgaacttctttactaaccctacaaaaaacctagtgtctataactaaagattctgaactgcccacctgcagctgtcttgatcgagttatacaaaaagacaaaggcccatattatacacaccttggggcaggaccaagtgttgctgctgtcagggaaatcatggagaataggtatggtcaaaaaggaaacgcaataaggatagaaatagtagtgtacaccggtaaagaagggaaaagctctcatgggtgtccaattgctaagtgggttttaagaagaagcagtgatgaagaaaaagttctttgtttggtccggcagcgtacaggccaccactgtccaactgctgtgatggtggtgctcatcatggtgtgggatggcatccctcttccaatggccgaccggctatacacagagctcacagagaatctaaagtcatacaatgggcaccctaccgacagaagatgcaccctcaatgaaaatcgtacctgtacatgtcaaggaattgatccagagacttgtggagcttcattctcttttggctgttcatggagtatgtactttaatggctgtaagtttggtagaagcccaagccccagaagatttagaattgatccaagctctcccttacatacctactatgaaagaattactaaaggacgtaatccagaaagaagatatatgaaaccggaacgaatcagtccgggacacgaggccatggtgagcaaagaaattagtcgaacttggtgttaagttaaataagttcaatacttatatattatattaaattaaaataa

SEQ ID NO: 5631 - DNA, 806 bp, synthetic construct; identical to SEQ ID NO: 974
  misc_feature 1..806: note = Synthetic polypeptide
  source 1..806: mol_type = other DNA

SEQ ID NO: 5632 - DNA, 822 bp, synthetic construct; identical to SEQ ID NO: 119
  misc_feature 1..822: note = Synthetic polypeptide
  source 1..822: mol_type = other DNA

SEQ ID NO: 5633 - DNA, 589 bp, synthetic construct
  misc_feature 1..589: note = Synthetic polypeptide
  source 1..589: mol_type = other DNA
atggccgcagaagaggtattgcagacggtggaccattataagactgagatagagaggctaaccaaggagctcacggagaccacccacgagaagatccaggctgccgagtacgggctggtggtgctggaggagaagctgaccctcaaacagcagtatgatgaactggaggctgagtacgacagcctcaaacaggagctggagcagctcaaagaggcatttgggcagtccttctccatccaccggaaggttgctgaagatggagagactcgggaggaaacgcttctgcaggagtcagcatcgaaggaggcttactatctggggaagatcttggagatgcagaacgagctgaaacagagccgggctgtggtcactaatgtacaggcagaaaacgagaggctcaccgcagtcgtgcaggatctgaaggagcgtatgaggacaaggcattcatcctctccggaggacacagcaacaaggtgccatcttggacgcagagagcagctctcaccagacactgaacctgccagcaccttaatcttagatcttcagcctccagaactgtgatcaataaatttgtgtgtttttataaatt

SEQ ID NO: 5634 - DNA, 775 bp, synthetic construct; identical to SEQ ID NO: 215
  misc_feature 1..775: note = Synthetic polypeptide
  source 1..775: mol_type = other DNA

SEQ ID NO: 5635 - DNA, 2362 bp, synthetic construct; identical to SEQ ID NO: 1664
  misc_feature 1..2362: note = Synthetic polypeptide
  source 1..2362: mol_type = other DNA

SEQ ID NO: 5636 - DNA, 2113 bp, synthetic construct; identical to SEQ ID NO: 1665
  misc_feature 1..2113: note = Synthetic polypeptide
  source 1..2113: mol_type = other DNA

SEQ ID NO: 5637 - DNA, 1399 bp, synthetic construct; identical to SEQ ID NO: 1666
  misc_feature 1..1399: note = Synthetic polypeptide
  source 1..1399: mol_type = other DNA

SEQ ID NO: 5638 - DNA, 2080 bp, synthetic construct; identical to SEQ ID NO: 1667
  misc_feature 1..2080: note = Synthetic polypeptide
  source 1..2080: mol_type = other DNA

SEQ ID NO: 5639 - DNA, 1761 bp, synthetic construct; identical to SEQ ID NO: 3913
  misc_feature 1..1761: note = Synthetic polypeptide
  source 1..1761: mol_type = other DNA

SEQ ID NO: 5640 - DNA, 1563 bp, synthetic construct; identical to SEQ ID NO: 3914
  misc_feature 1..1563: note = Synthetic polypeptide
  source 1..1563: mol_type = other DNA

SEQ ID NO: 5641 - DNA, 500 bp, synthetic construct; identical to SEQ ID NO: 204
  misc_feature 1..500: note = Synthetic polypeptide
  source 1..500: mol_type = other DNA

SEQ ID NO: 5642 - DNA, 656 bp, synthetic construct; identical to SEQ ID NO: 205
  misc_feature 1..656: note = Synthetic polypeptide
  source 1..656: mol_type = other DNA

SEQ ID NO: 5643 - DNA, 524 bp, synthetic construct; identical to SEQ ID NO: 207
  misc_feature 1..524: note = Synthetic polypeptide
  source 1..524: mol_type = other DNA

SEQ ID NO: 5644 - DNA, 628 bp, synthetic construct; identical to SEQ ID NO: 2222
  misc_feature 1..628: note = Synthetic polypeptide
  source 1..628: mol_type = other DNA

SEQ ID NO: 5645 - DNA, 1221 bp, synthetic construct; identical to SEQ ID NO: 122
  misc_feature 1..1221: note = Synthetic polypeptide
  source 1..1221: mol_type = other DNA

SEQ ID NO: 5646 - DNA, 572 bp, synthetic construct; identical to SEQ ID NO: 159
  misc_feature 1..572: note = Synthetic polypeptide
  source 1..572: mol_type = other DNA

SEQ ID NO: 5647 - DNA, 904 bp, synthetic construct
  misc_feature 1..904: note = Synthetic polypeptide
  source 1..904: mol_type = other DNA
atgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctagctgagcatggtagttcacgcctataatcccagcactttggggaacc

SEQ ID NO: 5648 - DNA, 1072 bp, synthetic construct
  misc_feature 1..1072: note = Synthetic polypeptide
  source 1..1072: mol_type = other DNA
atggcggccaacatgtaccgggtcggagattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctagctgagcatggtagttcacgcctataatcccagcactttggggaacc

SEQ ID NO: 5649 - DNA, 2389 bp, synthetic construct
  misc_feature 1..2389: note = Synthetic polypeptide
  source 1..2389: mol_type = other DNA
atggactcggaatattacagcggcgaccagtcagatgatggtggtgctaccccagtacaggatgaacgggattcagggtcagacggtgaggatgatgtaaatgagcaacactccggatcagacactggaagtgtagaacgtcattcagagaatgaaactagtgatcgagaagatggcctccccaaaggacatcatgtgacagactctgagaacgatgagcccttaaatcttaatgctagtgactctgaaagtgaggagcttcacaggcaaaaggacagcgactctgaatctgaggaacgtgcagagcctcctgcaagcgattctgaaaatgaggatgtcaatcagcatgggagcgactctgagagtgaagagaccaggaaattacctggtagtgactctgaaaatgaggaacttcttaatgggcatgcaagtgactcagaaaacgaagatgttgggaagcatcccgccagtgattctgagattgaggagctccagaagagtcctgctagtgactctgaaacagaagatgctctaaaacctcaaatcagtgactctgagagtgaggaacccccaaggcaccaagccagtgactccgaaaatgaggagcctcccaaacctcgaatgagtgattctgaaagtgaggagcttcctaaacctcaggtcagtgattcagaaagtgaggaacccccaaggcaccaggccagtgactctgaaaatgaggagcttcccaaacctcgtatcagtgactcagaaagtgaggaccctccgaggcaccaggccagtgactcagaaaatgaagagcttcccaaaccccgaatcagtgattcggaaagtgaggatcccccaaggaaccaggccagtgattcggaaaatgaggagctacccaaaccccgagtcagtgactctgagagtgaggggcctcagaaggggcctgccagtgactcagaaactgaggatgcgtccagacacaaacagaagccagagtcagatgatgacagcgacagggagaataagggagaggatacagaaatgcagaatgactccttccattcagacagccatatggacagaaaaaagtttcacagttctgatagtgaggaggaagaacacaaaaagcaaaaaatggacagtgatgaagatgaaaaagagggtgaggaggagaaagtagcgaagagaaaagctgctgtgctttctgatagtgaagatgaagagaaagcatcagcaaagaagagtcgtgttgtctctgatgcagatgactctgacagtgatgctgtatcagacaagtcaggcaaaagagagaagaccatagcatctgacagtgaggaagaagctgggaaagaattgtctgataagaaaaatgaagagaaggatctgtttgggagtgacagtgagtcaggcaatgaagaagaaaatcttattgcagacatatttggagaatctggtgatgaagaggaagaagaatttacagaatgaagatgaaataaggagggaattaattaacagtgtaccagctgaaggaaatacagaaggaaagaaatgcaagaaagaatgatctcagatggaaggttagagatgcaggagggagaaaagagcaacaaaagtatgtgtataagtctaaatgagtattgactatacaaaatgaaatgtatttaatgtggaatatatataaaattaaaacatgacagcagtaaattgggagcatacgtggaattgaagtgctcataggcctttgcaaatgtgtatgaatgtacattagtaaactgataagttagggtgcatgttgtagtctctaaagtgaccactaacaagactaaaatggaatgtgtaatttctaaactaatagggggggaaagtggaacaactagaactaatcagtcgaaaatgagcaggaaaagagaaagaactataggacaagggacaattagaaagtattacatggtaaaatagtagatttaaattttgataatatcagaaattaaattaaatgtaaatagtaaatattccagttaaaggacaacaattgccagacaggatcttaaaaaccagccatatactgatgtcaagagatttgtctgaaacagaaggtaaagctgaaaataaaggtgtatgaaaggggactttgtgtaaacatggaccaaaagaaaattgttgtggtatctataatattataaaagagggaggtagacattaaggcaaaaaaaagtacttaagataaagaggtcactttatatcgataaaaagattttaaaattgtttgcgcctaataacatggctttatagatatatgcacacttaaaaatcaaaaattgatagaactgaaaagagaaatggacaagtccataatctaagagaaatgtaactgacagaagaagcagatcgaaaaaaccag

SEQ ID NO: 5650 - DNA, 2410 bp, synthetic construct
  misc_feature 1..2410: note = Synthetic polypeptide
  source 1..2410: mol_type = other DNA
atgcctgcccgcccgccagcctgccgggtacggccttttccgccggggcttccagatgatggtggtgctaccccagtacaggatgaacgggattcagggtcagacggtgaggatgatgtaaatgagcaacactccggatcagacactggaagtgtagaacgtcattcagagaatgaaactagtgatcgagaagatggcctccccaaaggacatcatgtgacagactctgagaacgatgagcccttaaatcttaatgctagtgactctgaaagtgaggagcttcacaggcaaaaggacagcgactctgaatctgaggaacgtgcagagcctcctgcaagcgattctgaaaatgaggatgtcaatcagcatgggagcgactctgagagtgaagagaccaggaaattacctggtagtgactctgaaaatgaggaacttcttaatgggcatgcaagtgactcagaaaacgaagatgttgggaagcatcccgccagtgattctgagattgaggagctccagaagagtcctgctagtgactctgaaacagaagatgctctaaaacctcaaatcagtgactctgagagtgaggaacccccaaggcaccaagccagtgactccgaaaatgaggagcctcccaaacctcgaatgagtgattctgaaagtgaggagcttcctaaacctcaggtcagtgattcagaaagtgaggaacccccaaggcaccaggccagtgactctgaaaatgaggagcttcccaaacctcgtatcagtgactcagaaagtgaggaccctccgaggcaccaggccagtgactcagaaaatgaagagcttcccaaaccccgaatcagtgattcggaaagtgaggatcccccaaggaaccaggccagtgattcggaaaatgaggagctacccaaaccccgagtcagtgactctgagagtgaggggcctcagaaggggcctgccagtgactcagaaactgaggatgcgtccagacacaaacagaagccagagtcagatgatgacagcgacagggagaataagggagaggatacagaaatgcagaatgactccttccattcagacagccatatggacagaaaaaagtttcacagttctgatagtgaggaggaagaacacaaaaagcaaaaaatggacagtgatgaagatgaaaaagagggtgaggaggagaaagtagcgaagagaaaagctgctgtgctttctgatagtgaagatgaagagaaagcatcagcaaagaagagtcgtgttgtctctgatgcagatgactctgacagtgatgctgtatcagacaagtcaggcaaaagagagaagaccatagcatctgacagtgaggaagaagctgggaaagaattgtctgataagaaaaatgaagagaaggatctgtttgggagtgacagtgagtcaggcaatgaagaagaaaatcttattgcagacatatttggagaatctggtgatgaagaggaagaagaatttacagaatgaagatgaaataaggagggaattaattaacagtgtaccagctgaaggaaatacagaaggaaagaaatgcaagaaagaatgatctcagatggaaggttagagatgcaggagggagaaaagagcaacaaaagtatgtgtataagtctaaatgagtattgactatacaaaatgaaatgtatttaatgtggaatatatataaaattaaaacatgacagcagtaaattgggagcatacgtggaattgaagtgctcataggcctttgcaaatgtgtatgaatgtacattagtaaactgataagttagggtgcatgttgtagtctctaaagtgaccactaacaagactaaaatggaatgtgtaatttctaaactaatagggggggaaagtggaacaactagaactaatcagtcgaaaatgagcaggaaaagagaaagaactataggacaagggacaattagaaagtattacatggtaaaatagtagatttaaattttgataatatcagaaattaaattaaatgtaaatagtaaatattccagttaaaggacaacaattgccagacaggatcttaaaaaccagccatatactgatgtcaagagatttgtctgaaacagaaggtaaagctgaaaataaaggtgtatgaaaggggactttgtgtaaacatggaccaaaagaaaattgttgtggtatctataatattataaaagagggaggtagacattaaggcaaaaaaaagtacttaagataaagaggtcactttatatcgataaaaagattttaaaattgtttgcgcctaataacatggctttatagatatatgcacacttaaaaatcaaaaattgatagaactgaaaagagaaatggacaagtccataatctaagagaaatgtaactgacagaagaagcagatcgaaaaaaccag

SEQ ID NO: 5651 - DNA, 95 bp, synthetic construct; identical to SEQ ID NO: 1917
  misc_feature 1..95: note = Synthetic polypeptide
  source 1..95: mol_type = other DNA

SEQ ID NO: 5652 - DNA, 1146 bp, synthetic construct; identical to SEQ ID NO: 988
  misc_feature 1..1146: note = Synthetic polypeptide
  source 1..1146: mol_type = other DNA

SEQ ID NO: 5653 - DNA, 2721 bp, synthetic construct; identical to SEQ ID NO: 962
  misc_feature 1..2721: note = Synthetic polypeptide
  source 1..2721: mol_type = other DNA

SEQ ID NO: 5654 - DNA, 2549 bp, synthetic construct; identical to SEQ ID NO: 963
  misc_feature 1..2549: note = Synthetic polypeptide
  source 1..2549: mol_type = other DNA

SEQ ID NO: 5655 - DNA, 1052 bp, synthetic construct; identical to SEQ ID NO: 247
  misc_feature 1..1052: note = Synthetic polypeptide
  source 1..1052: mol_type = other DNA

SEQ ID NO: 5656 - DNA, 327 bp, synthetic construct; identical to SEQ ID NO: 246
  misc_feature 1..327: note = Synthetic polypeptide
  source 1..327: mol_type = other DNA

SEQ ID NO: 5657 - DNA, 1398 bp, synthetic construct; identical to SEQ ID NO: 948
  misc_feature 1..1398: note = Synthetic polypeptide
  source 1..1398: mol_type = other DNA

SEQ ID NO: 5658 - DNA, 1302 bp, synthetic construct; identical to SEQ ID NO: 949
  misc_feature 1..1302: note = Synthetic polypeptide
  source 1..1302: mol_type = other DNA

SEQ ID NO: 5659 - DNA, 770 bp, synthetic construct; identical to SEQ ID NO: 3389
  misc_feature 1..770: note = Synthetic polypeptide
  source 1..770: mol_type = other DNA

SEQ ID NO: 5660 - DNA, 103 bp, synthetic construct; identical to SEQ ID NO: 173
  misc_feature 1..103: note = Synthetic polypeptide
  source 1..103: mol_type = other DNA

SEQ ID NO: 5661 - DNA, 802 bp, synthetic construct; identical to SEQ ID NO: 2212
  misc_feature 1..802: note = Synthetic polypeptide
  source 1..802: mol_type = other DNA

SEQ ID NO: 5662 - DNA, 2141 bp, synthetic construct; identical to SEQ ID NO: 2213
  misc_feature 1..2141: note = Synthetic polypeptide
  source 1..2141: mol_type = other DNA

SEQ ID NO: 5663 - DNA, 2192 bp, synthetic construct; identical to SEQ ID NO: 2214
  misc_feature 1..2192: note = Synthetic polypeptide
  source 1..2192: mol_type = other DNA

SEQ ID NO: 5664 - DNA, 2015 bp, synthetic construct; identical to SEQ ID NO: 2215
  misc_feature 1..2015: note = Synthetic polypeptide
  source 1..2015: mol_type = other DNA

SEQ ID NO: 5665 - DNA, 276 bp, synthetic construct; identical to SEQ ID NO: 923
  misc_feature 1..276: note = Synthetic polypeptide
  source 1..276: mol_type = other DNA

SEQ ID NO: 5666 - DNA, 1420 bp, synthetic construct; identical to SEQ ID NO: 924
  misc_feature 1..1420: note = Synthetic polypeptide
  source 1..1420: mol_type = other DNA

SEQ ID NO: 5667 - DNA, 1336 bp, synthetic construct; identical to SEQ ID NO: 925
  misc_feature 1..1336: note = Synthetic polypeptide
  source 1..1336: mol_type = other DNA

SEQ ID NO: 5668 - DNA, 1069 bp, synthetic construct; identical to SEQ ID NO: 926
  misc_feature 1..1069: note = Synthetic polypeptide
  source 1..1069: mol_type = other DNA

SEQ ID NO: 5669 - DNA, 1345 bp, synthetic construct; identical to SEQ ID NO: 927
  misc_feature 1..1345: note = Synthetic polypeptide
  source 1..1345: mol_type = other DNA

SEQ ID NO: 5670 - DNA, 409 bp, synthetic construct
  misc_feature 1..409: note = Synthetic polypeptide
  source 1..409: mol_type = other DNA
atggcggaggatgtttcctcagcggccccgagcccgcggggctgtgcggatggtagggatgccgaccctactgaggagcagatggcagaaacagagagaaacgacgaggagcagttcgaatgccaggaactgctcgagtgccaggtgcaggtgggggcccccgaggaggaggaggaggaggaggaggacgcgggcctggtggccgaggccgaggccgtggctgccggctggatgctcgatttcctctgcctctctctttgccgagctttccgcgacggccgctccgaggacttccgcaggacccgcaacagcgcagaggattaaaaccttcatgggggcagagactggctatctgaagtcatcacctcctaacacaggctggcagtagatgttcagtaaatattgaatg

SEQ ID NO: 5671 - DNA, 1834 bp, synthetic construct; identical to SEQ ID NO: 133
  misc_feature 1..1834: note = Synthetic polypeptide
  source 1..1834: mol_type = other DNA

SEQ ID NO: 5672 - DNA, 1765 bp, synthetic construct; identical to SEQ ID NO: 135
  misc_feature 1..1765: note = Synthetic polypeptide
  source 1..1765: mol_type = other DNA

SEQ ID NO: 5673 - DNA, 2107 bp, synthetic construct
  misc_feature 1..2107: note = Synthetic polypeptide
  source 1..2107: mol_type = other DNA
atggctcggaaattagtgatgttcagggatgttgccattgacttctctcaggaagagtgggaatgcctggactctgctcagagagatttgtatagagatgtgatgttggagaactatagcaacttggtatcactagacttgccttcaaggtgtgcaagtaaggacttatctccagaaaagaacacttatgaaacagaattatcccaatgggaaatgagtgacagacttgaaaactgtgatcttgaagagtccaattccagggattatttggaagccaaaggcaagatggagaagcaacaagaaaatcagaaggaatatttcaggcaagggatgatcatatatgacaaaatgtccattttcaaccagcatacttacttatctcaacattcaagatgtcattctactgagaaaccctataaatgtaaggaatgtgggaaagccttcagacgagcctcacacctaacacaacatcaaagtattcatactggtgaaaaaccctatgaatgtaagcaatgcgggaaggcctttagtcgtgattcacaactcagtcttcatcagagacttcatactggtgagaaaccctatgcatgtaaggaatgtgggaaggcctttactcaaagctcacaacttattttacatcatagaattcatactggtgaaaaaccatataaatgtgaagaatgtgggaaagcctttattcgtagctcacaacttacccgacatcaaaaagttcatactggtgagaaaccttatgaatgtaaagaatgtgggaaggcctttactcagaattcacaacttacactacaccagagacttcatactggtgaaaagctctatgaatgtaaagaatgtaggaaggtctttactcagctctcacaacttattctgcataagagaattcataccggtgagaaaccctatgaatgtaaggaatgtggaaaagcttttatttgtggctcacagctttctcaacatcagaaaattcataatggggaaaaaccatatgaatgtaaggaatgtggaagggcctttattcggggctcactactgatgcaacatcagaggattcatactggtgaaaaaccctataaatgtgaagaatgtgggaaggcctttatccgtggctcacaacttactcaacaccagagaattcacaccaatgaaaagccctatgaatgtaaggaatgtggaaagatgtttagtcatggctcacaacttactcaacatcagagaatacacactggtgagaaaccctatcaatgtaaggaatgtggaaaagcgtttaatcgtggctcactccttacacgacaccagaggattcatactggtgagaaaccctatgaatgtaaagaatgtggaaaaacctttagtcgtggctcagaacttactcaacatgagcgaattcacacaggtgagaaaccctatgaatgtaaggaatgtgggaaatcttttattcgtggttcccagcttactcaacatcagagaatccatactggtgagaaaccttatgaatgtaaagaatgtagaatggcctttactcagagttcacatctttcccaacatcaaagacttcacactggtgagaaaccctatgtgtgtaatgaatgtggaaaggcctttgcgcgtggcttactacttatacaacatcagagaattcatactggtgagaaaccatatcaatgtaaggaatgtgggaaagcctttattcgtggttcacagttgactcaacatcagcgaattcacactggagaaaaaccctatgaatgcaaggagtgtggcaaggcctttagtcatggctctcagcttactctacatcagagaatccatactggtgagaagccctatgaatgcagagaatgtagaaaggcctttactcagagttcacatctttctcggcatcagagaattcatactgctggagctccgttactctcatggggactttgagaatggtatctgggtgttatggatcatggagcagaaatacagaaggagtctgcaaccctgatgactttgtggaacagccatactagctctggtctgcttgcctcctgtttctctttaaataaaattaaacatcttatttgttgatgctattgtagttctg

SEQ ID NO: 5674 - DNA, 681 bp, synthetic construct; identical to SEQ ID NO: 1642
  misc_feature 1..681: note = Synthetic polypeptide
  source 1..681: mol_type = other DNA

SEQ ID NO: 5675 - DNA, 534 bp, synthetic construct; identical to SEQ ID NO: 1643
  misc_feature 1..534: note = Synthetic polypeptide
  source 1..534: mol_type = other DNA

SEQ ID NO: 5676 - DNA, 270 bp, synthetic construct; identical to SEQ ID NO: 1644
  misc_feature 1..270: note = Synthetic polypeptide
  source 1..270: mol_type = other DNA

SEQ ID NO: 5677 - DNA, 596 bp, synthetic construct; identical to SEQ ID NO: 1645
  misc_feature 1..596: note = Synthetic polypeptide
  source 1..596: mol_type = other DNA

SEQ ID NO: 5678 - DNA, 5237 bp, synthetic construct; identical to SEQ ID NO: 3991
  misc_feature 1..5237: note = Synthetic polypeptide
  source 1..5237: mol_type = other DNA

SEQ ID NO: 5679 - DNA, 7292 bp, synthetic construct; identical to SEQ ID NO: 3992
  misc_feature 1..7292: note = Synthetic polypeptide
  source 1..7292: mol_type = other DNA

SEQ ID NO: 5680 - DNA, 980 bp, synthetic construct; identical to SEQ ID NO: 139
  misc_feature 1..980: note = Synthetic polypeptide
  source 1..980: mol_type = other DNA

SEQ ID NO: 5681 - DNA, 1256 bp, synthetic construct; identical to SEQ ID NO: 140
  misc_feature 1..1256: note = Synthetic polypeptide
  source 1..1256: mol_type = other DNA

SEQ ID NO: 5682 - DNA, 1277 bp, synthetic construct; identical to SEQ ID NO: 142
  misc_feature 1..1277: note = Synthetic polypeptide
  source 1..1277: mol_type = other DNA

SEQ ID NO: 5683 - DNA, 995 bp, synthetic construct
  misc_feature 1..995: note = Synthetic polypeptide
  source 1..995: mol_type = other DNA
atggcagataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccattcgcttcaagctcagcttatcaatatgggtgttattcctaccttagtgaaattactgggcatccactgccaaaatgcagctcttacagaaatgtgtcttgttgcatttggtaatttagcagaacttgagtcaagtaaagaacagtttgccagtacaaacattgctgaagagctagtaaaactcttcaagaaacaaatagaacatgataagagagaaatgatttttgaagttcttgctccattggcagaaaatggaaaacaggactaggaaggtcttcaatctgaaaaagatatctatgagaaggctgaagaaaacatcacaatcaatggtgaaataaaaaagcatttgctttgagattgggacaagaaggatcatccccgcttccatttaacattgtattgtaagaagtatccagtgcattaaagagaataaaagaaaaaaaattaagataaagcaataaaactctcattcatttatgatgtgattatgcatatttaattcaaaagaatctatagatcagttttatagatctttttttaaatcagaattttgttaggttactgccaaaaaacaaacaagaatttctatataccaaaaaagaaaaaacagaaaataaaatgtgaaaaata

SEQ ID NO: 5684 - DNA, 866 bp, synthetic construct
  misc_feature 1..866: note = Synthetic polypeptide
  source 1..866: mol_type = other DNA
atggcagataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccagtcaagtaaagaacagtttgccagtacaaacattgctgaagagctagtaaaactcttcaagaaacaaatagaacatgataagagagaaatgatttttgaagttcttgctccattggcagaaaatggaaaacaggactaggaaggtcttcaatctgaaaaagatatctatgagaaggctgaagaaaacatcacaatcaatggtgaaataaaaaagcatttgctttgagattgggacaagaaggatcatccccgcttccatttaacattgtattgtaagaagtatccagtgcattaaagagaataaaagaaaaaaaattaagataaagcaataaaactctcattcatttatgatgtgattatgcatatttaattcaaaagaatctatagatcagttttatagatctttttttaaatcagaattttgttaggttactgccaaaaaacaaacaagaatttctatataccaaaaaagaaaaaacagaaaataaaatgtgaaaaata

SEQ ID NO: 5685 - DNA, 1139 bp, synthetic construct
  misc_feature 1..1139: note = Synthetic polypeptide
  source 1..1139: mol_type = other DNA
atggataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccatgagggcagaagtgcagttgaccaagcaggtggtgcacagattgtaattgaccatttaaggtcactgtgcagtataacagatcccgccaatgagaagctcttgactgtcttttgtggcatgctgatgaactatagcaatgagaatgattcgcttcaagctcagcttatcaatatgggtgttattcctaccttagtgaaattactgggcatccactgccaaaatgcagctcttacagaaatgtgtcttgttgcatttggtaatttagcagaacttgagtcaagtaaagaacagtttgccagtacaaacattgctgaagagctagtaaaactcttcaagaaacaaatagaacatgataagagagaaatgatttttgaagttcttgctccattggcagaaaatggaaaacaggactaggaaggtcttcaatctgaaaaagatatctatgagaaggctgaagaaaacatcacaatcaatggtgaaataaaaaagcatttgctttgagattgggacaagaaggatcatccccgcttccatttaacattgtattgtaagaagtatccagtgcattaaagagaataaaagaaaaaaaattaagataaagcaataaaactctcattcatttatgatgtgattatgcatatttaattcaaaagaatctatagatcagttttatagatctttttttaaatcagaattttgttaggttactgccaaaaaacaaacaagaatttctatataccaaaaaagaaaaaacagaaaataaaatgtgaaaaata

SEQ ID NO: 5686 - DNA, 1142 bp, synthetic construct
  misc_feature 1..1142: note = Synthetic polypeptide
  source 1..1142: mol_type = other DNA
atggcagataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccatgagggcagaagtgcagttgaccaagcaggtggtgcacagattgtaattgaccatttaaggtcactgtgcagtataacagatcccgccaatgagaagctcttgactgtcttttgtggcatgctgatgaactatagcaatgagaatgattcgcttcaagctcagcttatcaatatgggtgttattcctaccttagtgaaattactgggcatccactgccaaaatgcagctcttacagaaatgtgtcttgttgcatttggtaatttagcagaacttgagtcaagtaaagaacagtttgccagtacaaacattgctgaagagctagtaaaactcttcaagaaacaaatagaacatgataagagagaaatgatttttgaagttcttgctccattggcagaaaatggaaaacaggactaggaaggtcttcaatctgaaaaagatatctatgagaaggctgaagaaaacatcacaatcaatggtgaaataaaaaagcatttgctttgagattgggacaagaaggatcatccccgcttccatttaacattgtattgtaagaagtatccagtgcattaaagagaataaaagaaaaaaaattaagataaagcaataaaactctcattcatttatgatgtgattatgcatatttaattcaaaagaatctatagatcagttttatagatctttttttaaatcagaattttgttaggttactgccaaaaaacaaacaagaatttctatataccaaaaaagaaaaaacagaaaataaaatgtgaaaaata

SEQ ID NO: 5687 - DNA, 992 bp, synthetic construct
  misc_feature 1..992: note = Synthetic polypeptide
  source 1..992: mol_type = other DNA
atggataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccattcgcttcaagctcagcttatcaatatgggtgttattcctaccttagtgaaattactgggcatccactgccaaaatgcagctcttacagaaatgtgtcttgttgcatttggtaatttagcagaacttgagtcaagtaaagaacagtttgccagtacaaacattgctgaagagctagtaaaactcttcaagaaacaaatagaacatgataagagagaaatgatttttgaagttcttgctccattggcagaaaatggaaaacaggactaggaaggtcttcaatctgaaaaagatatctatgagaaggctgaagaaaacatcacaatcaatggtgaaataaaaaagcatttgctttgagattgggacaagaaggatcatccccgcttccatttaacattgtattgtaagaagtatccagtgcattaaagagaataaaagaaaaaaaattaagataaagcaataaaactctcattcatttatgatgtgattatgcatatttaattcaaaagaatctatagatcagttttatagatctttttttaaatcagaattttgttaggttactgccaaaaaacaaacaagaatttctatataccaaaaaagaaaaaacagaaaataaaatgtgaaaaata

SEQ ID NO: 5688 - DNA, 292 bp, synthetic construct
  misc_feature 1..292: note = Synthetic polypeptide
  source 1..292: mol_type = other DNA
atggcctggccaaatgtttttcaaagagggtctctgctgtcccagttcagccatcatcatgttgtagtgttcctgctcactttcttcagttattcgttgctccatgcttcacgaaaaacatttagcaatgtcaaagtcagtatctctgagcagtggaccccaagtgcttttaacacgtcagttgagctgcctgtggagttcgtaagctggattattgagtattcacacacgtgtgtgagatgtgccacccttgaaccttgttacaacgtgggcacattattcacttgacatg

SEQ ID NO: 5689 - DNA, 329 bp, synthetic construct
  misc_feature 1..329: note = Synthetic polypeptide
  source 1..329: mol_type = other DNA
cgtggacgagttggaggacgaggaggagggggcggagactcggggcgccggggacccggcccggtacctcagccccggctggggcagcgcgagcgaggaggagccgagccgcgggcacagaactgcccagctcccgtggcttgagtctcagcaagtgttcagtctgaagcccttcctgctgcccactggcatagagttgaccccagaaaatccctggggttcttcggaataggagctcggtgaattcaaggaccatgcttgcttcgttcattgtatcttcagcacctagcacagcacccagcacataggacatgtttgttgactgaatg

SEQ ID NO: 5690 - DNA, 586 bp, synthetic construct; identical to SEQ ID NO: 401
  misc_feature 1..586: note = Synthetic polypeptide
  source 1..586: mol_type = other DNA

SEQ ID NO: 5691 - DNA, 829 bp, synthetic construct; identical to SEQ ID NO: 402
  misc_feature 1..829: note = Synthetic polypeptide
  source 1..829: mol_type = other DNA

SEQ ID NO: 5692 - DNA, 1060 bp, synthetic construct; identical to SEQ ID NO: 403
  misc_feature 1..1060: note = Synthetic polypeptide
  source 1..1060: mol_type = other DNA

SEQ ID NO: 5693 - DNA, 730 bp, synthetic construct; identical to SEQ ID NO: 406
  misc_feature 1..730: note = Synthetic polypeptide
  source 1..730: mol_type = other DNA

SEQ ID NO: 5694 - DNA, 496 bp, synthetic construct; identical to SEQ ID NO: 408
  misc_feature 1..496: note = Synthetic polypeptide
  source 1..496: mol_type = other DNA

SEQ ID NO: 5695 - DNA, 4340 bp, synthetic construct
  misc_feature 1..4340: note = Synthetic polypeptide
  source 1..4340: mol_type = other DNA
atgtcgagacccaggtttaatcctcgaggagactttccacttcaaaggccacgagcacctaacccttctgggatgaggcctccaggaccatttatgaggcctggatctatgggtctcccaagattttacccagcagggagagcacgtggaattccacacagatttgctggccatgaatcttatcagaacatggggccacagagaatgaatgttcaggtaactcaacacagaactgatccaagattgaccaaagaaaaactggattttcatgaagcacaacagaagaaggggaagcctcatggtagccggtgggatgatgagcctcatatatctgcatcagtggcagtgaaacagagttctgtaacacaggttacagagcagagtcccaaagtacagagccgctatacaaaagagagtgcctcaagtatcttagcaagttttggattatctaatgaagacctagaagaacttagtcgctatcctgatgaacaactaactcctgaaaatatgccattaattttgagggatataagaatgcgaaaaatggggcgccgattacctaatttaccttctcagagcagaaataaagaaacacttggtagtgaagcagtttcaagtaatgtgatcgattatgggcatgcaagcaaatatggctacacagaagatccacttgaagtacgtatttatgatcctgaaattccaactgatgaggtcgagaatgaatttcagtcacagcagaacatttctgcatctgttcccaatccaaatgtgatatgtaattctatgtttcctgttgaagacgtatttcgccaaatggacttccccggtgagtcctccaataatcggtcctttttctcagttgagagtggaaccaagatgtcaggcttacacatttcaggaggacagtcagtccttgaacccataaaatccgtcaaccaatccattaaccaaacagttagccagacaatgagtcaatctctgattcctccatctatgaaccagcaacctttttcgtcggaattaatttcatctgtaagccagcaagagcggatcccacatgaacctgtgattaattcatctaacgtacatgttggatcaagaggaagtaaaaagaattaccagtcacaggctgacattcccattcggtctccctttggtattgtgaaagcatcctggctaccaaagttttcacatgctgatgcccagaagatgaagagacttccaactccttctatgatgaatgattattatgcagcatctccaagaatatttccacatttgtgttctctgtgtaacgtagaatgtagtcatttgaaggattggattcagcatcaaaatacatctactcatattgagagctgtcgacagttacgtcaacagtatcctgattggaatcctgagatcctcccatcgagaagaaatgagggcaatagaaaagaaaatgaaactccacgaagacgttctcattcccccagtcctaggcgttctagaagatcaagctcaagtcacagattccgtcggtctcgaagcccaatgcattacatgtataggccgagaagtcgaagtccaagaatttgccatcgtttcatttctagatacagatccagatccagatcccgttcaccatatcgaattagaaatccatttagaggtagtccaaaatgctttcgatcagttagccctgagaggatgtcaaggagatcagtgagatcatcagatagaaaaaaagcattagaagatgtagtacaacgatctgggcatgggacagaatttaataaacagaagcatcttgaagctgctgataagggacattcaccagcacaaaagcctaaaactagcagtggaacaaaaccatcagttaaacctacaagcgctacaaagagtgattcaaatctaggaggacattctattcgttgtaaatcaaagaatcttgaagatgacactttgtcagaatgtaaacaggtgtctgataaagctgtttctctccagcgaaagcttcggaaagaacagtcattgcattatggttcggttcttcttataactgaattaccagaggatggttgtactgaagaagatgtgagaaaattatttcaaccatttgggaaagtgaatgatgtcctaattgttccatatagaaaagaggcttacctagaaatggaatttaaagaggcaattactgcaattatgaagtacattgaaacaacacctcttacgataaaaggaaaaagtgtgaaaatatgtgttccaggaaagaaaaaagcacagaacaaagaggtgaagaaaaagactttagagtcaaagaaagtatctgcatctaccttaaaaagagatgcagatgcttcaaaagctgttgaaattgttacttcaacttctgctggccctctttggattccagtacgatgcatcagaccataccatggcgtggctaggacccaacacagtaccagaagtgaaggaaatgatcctgcaggacccgcagctccagacaacacagcttcctcagacgacacaagccccggacattacctgggggatgctgaagaagacaacttacaaggctgagcaaatcctgctccagacacagaaaccattcactccagataatttgttccttgctctgctctctggtgtaagttacaactcacgtaggatcctttttatgctctcgcttcccctgcaacccgtaccggctacactctattgggctcatctgttagatccgcctttcttacgccctgttacctgggcaggcacccccttcccagcctctaataacgttaactgcttggctaggagggattgacttatcccagtagggtccgttattaatggcacacattggactaaggtgccaggtaacactacatatcactccattatcttcccactgtgtgtaaggttactatgtacctgccgaaacacaattatggctacaaatggcaaaggaattgccttaacattcttgtgccagtagcctcaaaccgggcaaggcaatcagtgccactttccccagcattcttccctgtgctaaagaacaaagccaggaaagtaatggattccactttggttgggaggtctgtcacgggggacaagcccttagtctccagttaggcaatttaacatcttagactggagcccccacggtcatttacagggcgaccatactgatgtttgcatccattgtggtgtcaatcttagtttcatagccatgtccgttcccctgtgatttgggccaaaggggggatgggatatcccagaccccaagtagagtccttgccaccccaagacacttaatggcatctgggacatcttagcaccacccttaacacctggcatgggacataacataattccagtaacaattatactatgacctttatgcataatcacacagatcagtgcctgatttgcactacccatccatatgtttttcttatgggaaccagtatttccattacacctcaaaactccatgtttgtgacctgagtgcaaggacaggcttgcttcacctcatgtatcattaattacaatatatctaatttaaatattactagtattatggtattaaggagacaatctgaggcattcctaccagtcagtttgatacacgattggcaaggttcctttgctcttgccaccttagaacatgccctgtcccaggtcagacaccaaagattcatagttaatcttacagcctttatagtctcagccatagtcatcctagcaactgctagttttgctgtagcatctattactgaatcagtacaaatagctgcttttgtagataacttggccagaaatgtgtctaatgaacttctcttacagcagggtacaaatcaaaaggttcttgcacatctgcaagccctcgaggctgccttggaacatgtaggggagtgacaagatgcgctggcattctgacagcaattaaactgtgactgggagcataagcatatctgtgtcacctctctaccatggaaccaatcaatacatagttgggatgaggtgaaacaacacctcggggtgaccttacatgataatttaacagcagacgtaaagcaacttaaaactaaaattctagaatccctaaacgccatagatctacatgtccaacaaacagttatatggaaggatgtgcaagaacatctctcctggatagaccctcactccttgattggaaaaaaatattactaattatactcatgtttgtcttatgttatttactaattctaggatgcaaagccggaatacgagcagtaatcgctacgcctgacaaacctgctgctgtgcacatctgtactcttcaatcaacaaaacctgatgcaaaaaacaaaagggggaga

SEQ ID NO: 5696 - DNA, 1034 bp, synthetic construct; identical to SEQ ID NO: 4670
  misc_feature 1..1034: note = Synthetic polypeptide
  source 1..1034: mol_type = other DNA

SEQ ID NO: 5697 - DNA, 1586 bp, synthetic construct; identical to SEQ ID NO: 4671
  misc_feature 1..1586: note = Synthetic polypeptide
  source 1..1586: mol_type = other DNA

SEQ ID NO: 5698 - DNA, 1588 bp, synthetic construct; identical to SEQ ID NO: 4672
  misc_feature 1..1588: note = Synthetic polypeptide
  source 1..1588: mol_type = other DNA

SEQ ID NO: 5699 - DNA, 1605 bp, synthetic construct
  misc_feature 1..1605: note = Synthetic polypeptide
  source 1..1605: mol_type = other DNA
atggctggtgcctcggtgaaagtggcagtgagggttcggccctttaacgcccgtgagaccagccaggatgccaagtgtgtggtcagcatgcagggcaacaccacctccatcatcaatcctaaacagagcaaggatgcccccaaaagcttcacctttgactactcctactggtcacacacttcgacggaggacccccagtttgcatctcagcagcaagtgtatcgggacattggagaagagatgctgctccacgcctttgaaggctacaacgtgtgcatctttgcctatgggcagaccggggctgggaaatcctataccatgatggggcgacaggagccagggcagcagggcatcgtgccccagctctgtgaggacctcttctctcgcgttagtgagaaccagagtgctcagctatcctactctgtggaggtgagctatatggagatctactgtgagcgggtacgagacctcttgaaccccaagagtcggggttctctgcgggtccgggagcaccccatcctgggcccgtacgtgcaggacctgtccaaattggctgtgacctcctacgcagacattgctgacctcatggactgtggaaataaagcacggactgtggctgccaccaacatgaatgagaccagcagccgttcccatgccgtctttaccatcgtcttcacacagcgctgccatgaccagctcacggggctggactcggagaaggtcagtaagatcagtttggtggaccttgctgggagtgagcgagccgactcctcaggggcccggggcatgcgcctgaaggaaggagccaacatcaataagtccctgactacactagggaaagtgatctcggcccttgcagatatgcaatcaaagaagcgaaagtcggattttatcccctacagggactctgtgctcacctggctgctcaaggaaaatttgggggggaactcacgcacagccatgattgcagccctgagccctgctgacatcaattacgaggagactctcagcaccctcaggtatgctgaccgcaccaagcaaatccgctgcaatgccatcatcaacgaggaccctaatgcccggctgattagagagctgcaggaggaagtagcccggctgcgggaactgctgatggctcagggactgtcagcctctgctctggaaggtcaaacagtaaattgttaagaggctaggctactgggtgactttcttgacagaagttcttgcaaaacgtcagagttgaagtggaccatagcctaacagatctcagtggagtgctttctggtatgtcatgctcagcctcactgatggaaatagtgtccaaatcagaggatgtgtaatccatgttgacggtcaggaatggaccctgcattcagtcttgagatcatcccattgaggatagttagggtgctgaagggcacagtgtggggagtatgagtgttcttggaaagagaaggataaggtagctagtgatgtttgccttccaacatttgagggattttcttgcagaagagaaagcagtaaggactttttatcccagagggcagaactagaaacactagcacacatgacgtgggaccagtttcagctcagcacagctaagaa

SEQ ID NO: 5700 - DNA, 2466 bp, synthetic construct; identical to SEQ ID NO: 1682
  misc_feature 1..2466: note = Synthetic polypeptide
  source 1..2466: mol_type = other DNA

SEQ ID NO: 5701 - DNA, 1806 bp, synthetic construct; identical to SEQ ID NO: 1683
  misc_feature 1..1806: note = Synthetic polypeptide
  source 1..1806: mol_type = other DNA

SEQ ID NO: 5702 - DNA, 2412 bp, synthetic construct; identical to SEQ ID NO: 1684
  misc_feature 1..2412: note = Synthetic polypeptide
  source 1..2412: mol_type = other DNA

SEQ ID NO: 5703 - DNA, 2211 bp, synthetic construct; identical to SEQ ID NO: 1685
  misc_feature 1..2211: note = Synthetic polypeptide
  source 1..2211: mol_type = other DNA

SEQ ID NO: 5704 - DNA, 364 bp, synthetic construct; identical to SEQ ID NO: 1686
  misc_feature 1..364: note = Synthetic polypeptide
  source 1..364: mol_type = other DNA

SEQ ID NO: 5705 - DNA, 317 bp, synthetic construct; identical to SEQ ID NO: 995
  misc_feature 1..317: note = Synthetic polypeptide
  source 1..317: mol_type = other DNA

SEQ ID NO: 5706 - DNA, 3520 bp, synthetic construct
  misc_feature 1..3520: note = Synthetic polypeptide
  source 1..3520: mol_type = other DNA
atggccacctcggagtacccctactcggagtgccagaatgcggcccagatctaccgcaaggtcacctgtggtatcaagccggccagctttgagaaagtgcacgatcctgaaatcaaggagattattggggagtgtatctgcaaaaacaaggaggaaaggtacgagatcaaagacctgctgagccacgccttcttcgcagaggacacaggcgtgagggtggagctcgcggaggaggaccacggcaggaagtccaccatcgccctgaggctctgggtggaagaccccaagaaactgaagggaaagcccaaggacaatggagccatagagttcaccttcgacctggagaaggagacgccggatgaggtggcccaagagatgattgagtctggattcttccacgagagtgacgtcaagatcgtggccaagtccatccgtgaccgcgtggccttgatccagtggcggcgggagaggatctggcccgcgctgcagcccaaggagcagcaggatgtgggcagcccggacaaggccaggggtccgccggtgcccctgcaggtccaggtgacctaccatgcacaggctgggcagcccgggccaccagagcccgaggagccggaggccgaccagcacctcctgccacctacgttgccgaccagcgccacctccctggcctcggacagcaccttcgacagcggccagggctctaccgtgtactcagactcgcagagcagccagcagagcgtgatgcttggctcccttgccgacgcagcgccgtccccggcccagtgtgtgtgcagcccccctgtgagcgaggggcccgtcctgccgcagagcctgccctcgctgggggcctaccagcagcccacggctgcacctggcttgccggtgggctctgtcccggcccccgcctgccctccgtccctccagcagcacttcccggatccggccatgagcttcgcccccgtgctgccgccgcccagcacccccatgcccacgggcccaggccagccagcaccccccggccagcagcctcctccgctggcccagccgacacccctgccgcaggtcctggccccacagcccgtggtccccctccagccggttcccccccacctgccaccgtacctggctccagcctcccaggtgggggcccccgctcagctgaagcccctccagatgccacaggcgcccctgcagccgcttgctcaagtccctccgcagatgcccccgattcctgttgtgccccccatcacgcccctggcgggaatcgacggcctccctccggccctcccagacctgccgaccgcgactgtgcctcccgtgccaccacctcagtatttctctccagccgtgatcttgccgagcctcgctgccccactcccccctgcgtccccagccttgcctctgcaggctgtgaagctgccccacccccctggggcgcccctggccatgccctgccggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcgccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaaggcttcgaacatcagtcagtgaaggaccctgcaagactgaaaaaaagtcactacagttatctcagcctactgccttgaaaaagtttctattccagagcagggaaggaagagcccaggcagagcttgggagattgtggagtgaggagaccaagctgagagtgtggagagacccaaatgtcaagaatttccaaggcggagttctggagaggagagagctgcggagagaagagtctgaagataacgggtgattcccctggatgatttcgcagagcactgtgtgtgaggaaactcacccaggctgaggaatgacccaccacgaaggatcagagggagtggacccgggaactcacacaggcctgggaatgtctgttcctgccagccagctggaaagccttataattcaaggggttttgggtacagtacaaaaaaggcgcttgcctcagtcctggaggataattagccctagactaagtgcttctcttacctcacctgtcagatcttaagagcaggatctgagaagatccaattgtttcaaggtaacttaactgcatcccacaacacacttcaagaatgtttataggaatacaaattcatccagcacccaatatgttaaattttacattatctggcatccaatccaaattatgagaca

SEQ ID NO: 5707 - DNA, 4684 bp, synthetic construct
  misc_feature 1..4684: note = Synthetic polypeptide
  source 1..4684: mol_type = other DNA
atggacggcgatggcggccgccgagacgtccccggcacgctgatggagcccgggcgcggcgcggggcccgcgggcatggcggagcctcgggcgaaggcggcgcggccggggccccagcgctttctgcggcgcagcgtggtagagtcggaccaggaggagccgccgggcttggaggcagccgaggcgccgggcccgcagcccccgcagcccctgcagcgccgggtgcttctgctctgcaagacgcgccgcctcatcgcggagcgcgcccgcggacgccccgccgcccccgcgcccgcagcgctggtagcgcagccgggagcccccggagcccccgcggacgccggccccgagcccgtgggcacgcaggagcccggcccggaccccatcgcagccgctgtcgaaaccgcgcctgcccccgacggcggccccagggaggaggcggcggcgaccgtgaggaaggaggatgagggggcggccgaggcgaagcctgagcccgggcgcactcgccgggacgagcccgaagaggaggaggacgacgaggacgacctcaaggccgtggccacctctctggacggccgcttcctcaagttcgacatcgagctgggccgcggttccttcaagacggtctacaaggggctggacacggagacctgggtggaggtggcctggtgtgagctgcaggaccggaagctcaccaagctggagcggcagcggttcaaggaagaggctgagatgctgaaaggcctgcagcaccccaacatcgtgcgcttctacgacttctgggagtccagcgccaagggcaagcggtgcattgtgctggtgacggagctgatgacctcagggacgctgaagacatacctgaagcggttcaaggtgatgaagcccaaggttctccgcagctggtgccggcagatcctgaagggcctgctgttcctgcacacaaggacgccacccatcatccaccgagacctgaaatgtgacaatattttcatcaccggaccaactgggtctgtgaagattggcgacttgggcctggccactctgaaaagagcgtcatttgccaaaagtgtgataggtactcccgagttcatggcgcccgagatgtacgaggagcactacgatgagtccgtggacgtctatgcctttgggatgtgcatgctggagatggccacctcggagtacccctactcggagtgccagaatgcggcccagatctaccgcaaggtcacctgtggtatcaagccggccagctttgagaaagtgcacgatcctgaaatcaaggagattattggggagtgtatctgcaaaaacaaggaggaaaggtacgagatcaaagacctgctgagccacgccttcttcgcagaggacacaggcgtgagggtggagctcgcggaggaggaccacggcaggaagtccaccatcgccctgaggctctgggtggaagaccccaagaaactgaagggaaagcccaaggacaatggagccatagagttcaccttcgacctggagaaggagacgccggatgaggtggcccaagagatgattgagtctggattcttccacgagagtgacgtcaagatcgtggccaagtccatccgtgaccgcgtggccttgatccagtggcggcgggagaggatctggcccgcgctgcagcccaaggagcagcaggatgtgggcagcccggacaaggccaggggtccgccggtgcccctgcaggtccaggtgacctaccatgcacaggctgggcagcccgggccaccagagcccgaggagccggaggccgaccagcacctcctgccacctacgttgccgaccagcgccacctccctggcctcggacagcaccttcgacagcggccagggctctaccgtgtactcagactcgcagagcagccagcagagcgtgatgcttggctcccttgccgacgcagcgccgtccccggcccagtgtgtgtgcagcccccctgtgagcgaggggcccgtcctgccgcagagcctgccctcgctgggggcctaccagcagcccacggctgcacctggcttgccggtgggctctgtcccggcccccgcctgccctccgtccctccagcagcacttcccggatccggccatgagcttcgcccccgtgctgccgccgcccagcacccccatgcccacgggcccaggccagccagcaccccccggccagcagcctcctccgctggcccagccgacacccctgccgcaggtcctggccccacagcccgtggtccccctccagccggttcccccccacctgccaccgtacctggctccagcctcccaggtgggggcccccgctcagctgaagcccctccagatgccacaggcgcccctgcagccgcttgctcaagtccctccgcagatgcccccgattcctgttgtgccccccatcacgcccctggcgggaatcgacggcctccctccggccctcccagacctgccgaccgcgactgtgcctcccgtgccaccacctcagtatttctctccagccgtgatcttgccgagcctcgctgccccactcccccctgcgtccccagccttgcctctgcaggctgtgaagctgccccacccccctggggcgcccctggccatgccctgccggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcgccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaaggcttcgaacatcagtcagtgaaggaccctgcaagactgaaaaaaagtcactacagttatctcagcctactgccttgaaaaagtttctattccagagcagggaaggaagagcccaggcagagcttgggagattgtggagtgaggagaccaagctgagagtgtggagagacccaaatgtcaagaatttccaaggcggagttctggagaggagagagctgcggagagaagagtctgaagataacgggtgattcccctggatgatttcgcagagcactgtgtgtgaggaaactcacccaggctgaggaatgacccaccacgaaggatcagagggagtggacccgggaactcacacaggcctgggaatgtctgttcctgccagccagctggaaagccttataattcaaggggttttgggtacagtacaaaaaaggcgcttgcctcagtcctggaggataattagccctagactaagtgcttctcttacctcacctgtcagatcttaagagcaggatctgagaagatccaattgtttcaaggtaacttaactgcatcccacaacacacttcaagaatgtttataggaatacaaattcatccagcacccaatatgttaaattttacattatctggcatccaatccaaattatgagaca

SEQ ID NO: 5708 - DNA, 4671 bp, synthetic construct
  misc_feature 1..4671: note = Synthetic polypeptide
  source 1..4671: mol_type = other DNA
gcggccgccgagacgtccccggcacgctgatggagcccgggcgcggcgcggggcccgcgggcatggcggagcctcgggcgaaggcggcgcggccggggccccagcgctttctgcggcgcagcgtggtagagtcggaccaggaggagccgccgggcttggaggcagccgaggcgccgggcccgcagcccccgcagcccctgcagcgccgggtgcttctgctctgcaagacgcgccgcctcatcgcggagcgcgcccgcggacgccccgccgcccccgcgcccgcagcgctggtagcgcagccgggagcccccggagcccccgcggacgccggccccgagcccgtgggcacgcaggagcccggcccggaccccatcgcagccgctgtcgaaaccgcgcctgcccccgacggcggccccagggaggaggcggcggcgaccgtgaggaaggaggatgagggggcggccgaggcgaagcctgagcccgggcgcactcgccgggacgagcccgaagaggaggaggacgacgaggacgacctcaaggccgtggccacctctctggacggccgcttcctcaagttcgacatcgagctgggccgcggttccttcaagacggtctacaaggggctggacacggagacctgggtggaggtggcctggtgtgagctgcaggaccggaagctcaccaagctggagcggcagcggttcaaggaagaggctgagatgctgaaaggcctgcagcaccccaacatcgtgcgcttctacgacttctgggagtccagcgccaagggcaagcggtgcattgtgctggtgacggagctgatgacctcagggacgctgaagacatacctgaagcggttcaaggtgatgaagcccaaggttctccgcagctggtgccggcagatcctgaagggcctgctgttcctgcacacaaggacgccacccatcatccaccgagacctgaaatgtgacaatattttcatcaccggaccaactgggtctgtgaagattggcgacttgggcctggccactctgaaaagagcgtcatttgccaaaagtgtgataggtactcccgagttcatggcgcccgagatgtacgaggagcactacgatgagtccgtggacgtctatgcctttgggatgtgcatgctggagatggccacctcggagtacccctactcggagtgccagaatgcggcccagatctaccgcaaggtcacctgtggtatcaagccggccagctttgagaaagtgcacgatcctgaaatcaaggagattattggggagtgtatctgcaaaaacaaggaggaaaggtacgagatcaaagacctgctgagccacgccttcttcgcagaggacacaggcgtgagggtggagctcgcggaggaggaccacggcaggaagtccaccatcgccctgaggctctgggtggaagaccccaagaaactgaagggaaagcccaaggacaatggagccatagagttcaccttcgacctggagaaggagacgccggatgaggtggcccaagagatgattgagtctggattcttccacgagagtgacgtcaagatcgtggccaagtccatccgtgaccgcgtggccttgatccagtggcggcgggagaggatctggcccgcgctgcagcccaaggagcagcaggatgtgggcagcccggacaaggccaggggtccgccggtgcccctgcaggtccaggtgacctaccatgcacaggctgggcagcccgggccaccagagcccgaggagccggaggccgaccagcacctcctgccacctacgttgccgaccagcgccacctccctggcctcggacagcaccttcgacagcggccagggctctaccgtgtactcagactcgcagagcagccagcagagcgtgatgcttggctcccttgccgacgcagcgccgtccccggcccagtgtgtgtgcagcccccctgtgagcgaggggcccgtcctgccgcagagcctgccctcgctgggggcctaccagcagcccacggctgcacctggcttgccggtgggctctgtcccggcccccgcctgccctccgtccctccagcagcacttcccggatccggccatgagcttcgcccccgtgctgccgccgcccagcacccccatgcccacgggcccaggccagccagcaccccccggccagcagcctcctccgctggcccagccgacacccctgccgcaggtcctggccccacagcccgtggtccccctccagccggttcccccccacctgccaccgtacctggctccagcctcccaggtgggggcccccgctcagctgaagcccctccagatgccacaggcgcccctgcagccgcttgctcaagtccctccgcagatgcccccgattcctgttgtgccccccatcacgcccctggcgggaatcgacggcctccctccggccctcccagacctgccgaccgcgactgtgcctcccgtgccaccacctcagtatttctctccagccgtgatcttgccgagcctcgctgccccactcccccctgcgtccccagccttgcctctgcaggctgtgaagctgccccacccccctggggcgcccctggccatgccctgccggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcgccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaaggcttcgaacatcagtcagtgaaggaccctgcaagactgaaaaaaagtcactacagttatctcagcctactgccttgaaaaagtttctattccagagcagggaaggaagagcccaggcagagcttgggagattgtggagtgaggagaccaagctgagagtgtggagagacccaaatgtcaagaatttccaaggcggagttctggagaggagagagctgcggagagaagagtctgaagataacgggtgattcccctggatgatttcgcagagcactgtgtgtgaggaaactcacccaggctgaggaatgacccaccacgaaggatcagagggagtggacccgggaactcacacaggcctgggaatgtctgttcctgccagccagctggaaagccttataattcaaggggttttgggtacagtacaaaaaaggcgcttgcctcagtcctggaggataattagccctagactaagtgcttctcttacctcacctgtcagatcttaagagcaggatctgagaagatccaattgtttcaaggtaacttaactgcatcccacaacacacttcaagaatgtttataggaatacaaattcatccagcacccaatatgttaaattttacattatctggcatccaatccaaattatgagaca

SEQ ID NO: 5709 - DNA, 3494 bp, synthetic construct
  misc_feature 1..3494: note = Synthetic polypeptide
  source 1..3494: mol_type = other DNA
ggagtgccagaatgcggcccagatctaccgcaaggtcacctgtggtatcaagccggccagctttgagaaagtgcacgatcctgaaatcaaggagattattggggagtgtatctgcaaaaacaaggaggaaaggtacgagatcaaagacctgctgagccacgccttcttcgcagaggacacaggcgtgagggtggagctcgcggaggaggaccacggcaggaagtccaccatcgccctgaggctctgggtggaagaccccaagaaactgaagggaaagcccaaggacaatggagccatagagttcaccttcgacctggagaaggagacgccggatgaggtggcccaagagatgattgagtctggattcttccacgagagtgacgtcaagatcgtggccaagtccatccgtgaccgcgtggccttgatccagtggcggcgggagaggatctggcccgcgctgcagcccaaggagcagcaggatgtgggcagcccggacaaggccaggggtccgccggtgcccctgcaggtccaggtgacctaccatgcacaggctgggcagcccgggccaccagagcccgaggagccggaggccgaccagcacctcctgccacctacgttgccgaccagcgccacctccctggcctcggacagcaccttcgacagcggccagggctctaccgtgtactcagactcgcagagcagccagcagagcgtgatgcttggctcccttgccgacgcagcgccgtccccggcccagtgtgtgtgcagcccccctgtgagcgaggggcccgtcctgccgcagagcctgccctcgctgggggcctaccagcagcccacggctgcacctggcttgccggtgggctctgtcccggcccccgcctgccctccgtccctccagcagcacttcccggatccggccatgagcttcgcccccgtgctgccgccgcccagcacccccatgcccacgggcccaggccagccagcaccccccggccagcagcctcctccgctggcccagccgacacccctgccgcaggtcctggccccacagcccgtggtccccctccagccggttcccccccacctgccaccgtacctggctccagcctcccaggtgggggcccccgctcagctgaagcccctccagatgccacaggcgcccctgcagccgcttgctcaagtccctccgcagatgcccccgattcctgttgtgccccccatcacgcccctggcgggaatcgacggcctccctccggccctcccagacctgccgaccgcgactgtgcctcccgtgccaccacctcagtatttctctccagccgtgatcttgccgagcctcgctgccccactcccccctgcgtccccagccttgcctctgcaggctgtgaagctgccccacccccctggggcgcccctggccatgccctgccggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcgccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaaggcttcgaacatcagtcagtgaaggaccctgcaagactgaaaaaaagtcactacagttatctcagcctactgccttgaaaaagtttctattccagagcagggaaggaagagcccaggcagagcttgggagattgtggagtgaggagaccaagctgagagtgtggagagacccaaatgtcaagaatttccaaggcggagttctggagaggagagagctgcggagagaagagtctgaagataacgggtgattcccctggatgatttcgcagagcactgtgtgtgaggaaactcacccaggctgaggaatgacccaccacgaaggatcagagggagtggacccgggaactcacacaggcctgggaatgtctgttcctgccagccagctggaaagccttataattcaaggggttttgggtacagtacaaaaaaggcgcttgcctcagtcctggaggataattagccctagactaagtgcttctcttacctcacctgtcagatcttaagagcaggatctgagaagatccaattgtttcaaggtaacttaactgcatcccacaacacacttcaagaatgtttataggaatacaaattcatccagcacccaatatgttaaattttacattatctggcatccaatccaaattatgagaca

SEQ ID NO: 5710 - DNA, 1074 bp, synthetic construct
  misc_feature 1..1074: note = Synthetic polypeptide
  source 1..1074: mol_type = other DNA
gccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaaggcttcgaacatcagtcagtgaaggaccctgcaagactgaaaaaaagtcactacagttatctcagcctactgccttgaaaaagtttctattccagagcagggaaggaagagcccaggcagagcttgggagattgtggagtgaggagaccaagctgagagtgtggagagacccaaatgtcaagaatttccaaggcggagttctggagaggagagagctgcggagagaagagtctgaagataacgggtgattcccctggatgatttcgcagagcactgtgtgtgaggaaactcacccaggctgaggaatgacccaccacgaaggatcagagggagtggacccgggaactcacacaggcctgggaatgtctgttcctgccagccagctggaaagccttataattcaaggggttttgggtacagtacaaaaaaggcgcttgcctcagtcctggaggataattagccctagactaagtgcttctcttacctcacctgtcagatcttaagagcaggatctgagaagatccaattgtttcaaggtaacttaactgcatcccacaacacacttcaagaatgtttataggaatacaaattcatccagcacccaatatgttaaattttacattatctggcatccaatccaaattatgagaca

SEQ ID NO: 5711 - DNA, 729 bp, synthetic construct
  misc_feature 1..729: note = Synthetic polypeptide
  source 1..729: mol_type = other DNA
atggccggcctccgagggaacgctgtggctggcctcctctggatgctgctgctgtggagtgggggcggcggctgccaggctcagcgggcaggttgcaaaagtgtccactacgatctggtcttcctcctggacacctcctccagcgtgggcaaggaggactttgagaaggtccggcagtgggtggccaacctggtggacaccttcgaggtgggccccgaccgcacccgtgtgggggtcgtgcgctacagcgaccggcccaccacggccttcgagttgggactctttggctcgcaggaggaggtcaaggcggctgcccggcgtctcgcctaccacgggggcaacaccaacacgggagacgcgctccgctacatcacggcccgcagcttctccccacacgccggcggccgccccagggaccgcgcctacaagcaggtggccatcctgctcaccgacggccgcagccaggacctggtgctggacgccgcggcggcagcccaccgcgctggcatccgcatctttgccgtgggcgtgggcgaggcactcaaggaggagctggaggagatcgcctcagagcccaagtccgcccacgtcttccacgtgtccgacttcaatgccatcgacaagatccggggcaagctgcggcgccgtctttgtgaaacatctgtgaaatgggtagaacaagcccacctatgactgtgaagattcaatgcattaatacaggaaaagtgc

SEQ ID NO: 5712 - DNA, 55 bp, synthetic construct; identical to SEQ ID NO: 291
  misc_feature 1..55: note = Synthetic polypeptide
  source 1..55: mol_type = other DNA

SEQ ID NO: 5713 - DNA, 25 bp, synthetic construct
  misc_feature 1..25: note = Synthetic polypeptide
  source 1..25: mol_type = other DNA
atgagcgtcctttcgtttttttaaa

SEQ ID NO: 5714 - DNA, 2161 bp, synthetic construct; identical to SEQ ID NO: 288
  misc_feature 1..2161: note = Synthetic polypeptide
  source 1..2161: mol_type = other DNA

SEQ ID NO: 5715 - DNA, 2140 bp, synthetic construct; identical to SEQ ID NO: 289
  misc_feature 1..2140: note = Synthetic polypeptide
  source 1..2140: mol_type = other DNA

SEQ ID NO: 5716 - DNA, 529 bp, synthetic construct; identical to SEQ ID NO: 287
  misc_feature 1..529: note = Synthetic polypeptide
  source 1..529: mol_type = other DNA

SEQ ID NO: 5717 - DNA, 4119 bp, synthetic construct; identical to SEQ ID NO: 4714
  misc_feature 1..4119: note = Synthetic polypeptide
  source 1..4119: mol_type = other DNA

SEQ ID NO: 5718 - DNA, 4059 bp, synthetic construct; identical to SEQ ID NO: 4715
  misc_feature 1..4059: note = Synthetic polypeptide
  source 1..4059: mol_type = other DNA

SEQ ID NO: 5719 - DNA, 817 bp, synthetic construct; identical to SEQ ID NO: 1990
  misc_feature 1..817: note = Synthetic polypeptide
  source 1..817: mol_type = other DNA

SEQ ID NO: 5720 - DNA, 603 bp, synthetic construct; identical to SEQ ID NO: 1012
  misc_feature 1..603: note = Synthetic polypeptide
  source 1..603: mol_type = other DNA

SEQ ID NO: 5721 - DNA, 270 bp, synthetic construct; identical to SEQ ID NO: 5331
  misc_feature 1..270: note = Synthetic polypeptide
  source 1..270: mol_type = other DNA

SEQ ID NO: 5722 - DNA, 255 bp, synthetic construct; identical to SEQ ID NO: 5332
  misc_feature 1..255: note = Synthetic polypeptide
  source 1..255: mol_type = other DNA

SEQ ID NO: 5723 - DNA, 336 bp, synthetic construct; identical to SEQ ID NO: 5333
  misc_feature 1..336: note = Synthetic polypeptide
  source 1..336: mol_type = other DNA

SEQ ID NO: 5724 - DNA, 157 bp, synthetic construct; identical to SEQ ID NO: 1500
  misc_feature 1..157: note = Synthetic polypeptide
  source 1..157: mol_type = other DNA

SEQ ID NO: 5725 - DNA, 1490 bp, synthetic construct; identical to SEQ ID NO: 1677
  misc_feature 1..1490: note = Synthetic polypeptide
  source 1..1490: mol_type = other DNA

SEQ ID NO: 5726 - DNA, 1451 bp, synthetic construct; identical to SEQ ID NO: 1678
  misc_feature 1..1451: note = Synthetic polypeptide
  source 1..1451: mol_type = other DNA

SEQ ID NO: 5727 - DNA, 926 bp, synthetic construct; identical to SEQ ID NO: 1679
  misc_feature 1..926: note = Synthetic polypeptide
  source 1..926: mol_type = other DNA

SEQ ID NO: 5728 - DNA, 1451 bp, synthetic construct; identical to SEQ ID NO: 1680
  misc_feature 1..1451: note = Synthetic polypeptide
  source 1..1451: mol_type = other DNA

SEQ ID NO: 5729 - DNA, 1039 bp, synthetic construct
  misc_feature 1..1039: note = Synthetic polypeptide
  source 1..1039: mol_type = other DNA
atgaagtacattctggttactggtggtgttatatcaggaattggaaaaggaatcattgccagcagtgtgggcacaatactcaagtcatgtggtttacatgtaacttcaatcaaaattgacccctacattaacattgatgcaggaacattctctccttatgagcatggtgaggtttttgtgctggatgatggtggggaagtagaccttgacctgggtaactatgagcggttccttgacatccgcctcaccaaggacaataatctgaccactggaaagatataccagtatgtcattaacaaggaacggaaaggagattacttggggaaaactgtccaagttgtccctcatatcacagatgcaatccaggagtgggtgatgagacaggcgttaatacctgtagatgaagatggcctggaacctcaagtgtgtgttattgagcttggtggaaccgtgggggacatagaaagcatgccctttattgaggccttccgtcagttccaattcaaggtcaaaagagagaacttttgtaacatccacgtcagtctagttccccagccaagttcaacaggggaacagaagactaaacctacccagaatagtgttcgggaacttagaggacttgggctttccccagatctggttgtatgcaggtgctcaaatccacttgacacatcagtgaaggagaaaatatcaatgttctgccatgttgagcctgaacaagtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacagatatgatcgcttgctggagacctgctctattgcccttgtgggcaaatacacgaagttctcagactcctatgcctctgtcattaaggctctggagcattctgcactggccatcaaccacaaattggaaatcaagtagaaaccactcagcaatgaaaaggaagaaacca

SEQ ID NO: 5730 - DNA, 346 bp, synthetic construct
  misc_feature 1..346: note = Synthetic polypeptide
  source 1..346: mol_type = other DNA
atgttctgccatgttgagcctgaacaagtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacagatatgatcgcttgctggagacctgctctattgcccttgtgggcaaatacacgaagttctcagactcctatgcctctgtcattaaggctctggagcattctgcactggccatcaaccacaaattggaaatcaagtagaaaccactcagcaatgaaaaggaagaaacca

SEQ ID NO: 5731 - DNA, 575 bp, synthetic construct; identical to SEQ ID NO: 2296
  misc_feature 1..575: note = Synthetic polypeptide
  source 1..575: mol_type = other DNA

SEQ ID NO: 5732 - DNA, 582 bp, synthetic construct; identical to SEQ ID NO: 1259
  misc_feature 1..582: note = Synthetic polypeptide
  source 1..582: mol_type = other DNA

SEQ ID NO: 5733 - DNA, 1215 bp, synthetic construct; identical to SEQ ID NO: 1260
  misc_feature 1..1215: note = Synthetic polypeptide
  source 1..1215: mol_type = other DNA

SEQ ID NO: 5734 - DNA, 705 bp, synthetic construct; identical to SEQ ID NO: 1261
  misc_feature 1..705: note = Synthetic polypeptide
  source 1..705: mol_type = other DNA

SEQ ID NO: 5735 - DNA, 393 bp, synthetic construct; identical to SEQ ID NO: 1400
  misc_feature 1..393: note = Synthetic polypeptide
  source 1..393: mol_type = other DNA

SEQ ID NO: 5736 - DNA, 272 bp, synthetic construct; identical to SEQ ID NO: 1401
  misc_feature 1..272: note = Synthetic polypeptide
  source 1..272: mol_type = other DNA

SEQ ID NO: 5737 - DNA, 175 bp, synthetic construct
  misc_feature 1..175: note = Synthetic polypeptide
  source 1..175: mol_type = other DNA
atggcagaagaaactggacagagtaaattagctgcagccaagaaaaagttcaaagaatattggcagagaaaccgccctggtgttccagcagcagcgaagaggaacacgaaagcaaatggcagtagccctgagacggccgcttctggtggttgccactcatctgaggcttacatgg

SEQ ID NO: 5738 - DNA, 1640 bp, synthetic construct; identical to SEQ ID NO: 2480
  misc_feature 1..1640: note = Synthetic polypeptide
  source 1..1640: mol_type = other DNA

SEQ ID NO: 5739 - DNA, 1435 bp, synthetic construct; identical to SEQ ID NO: 2481
  misc_feature 1..1435: note = Synthetic polypeptide
  source 1..1435: mol_type = other DNA

SEQ ID NO: 5740 - DNA, 1628 bp, synthetic construct; identical to SEQ ID NO: 2482
  misc_feature 1..1628: note = Synthetic polypeptide
  source 1..1628: mol_type = other DNA

SEQ ID NO: 5741 - DNA, 2848 bp, synthetic construct; identical to SEQ ID NO: 3654
  misc_feature 1..2848: note = Synthetic polypeptide
  source 1..2848: mol_type = other DNA

SEQ ID NO: 5742 - DNA, 181 bp, synthetic construct; identical to SEQ ID NO: 5321
  misc_feature 1..181: note = Synthetic polypeptide
  source 1..181: mol_type = other DNA

SEQ ID NO: 5743 - DNA, 578 bp, synthetic construct; identical to SEQ ID NO: 1946
  misc_feature 1..578: note = Synthetic polypeptide
  source 1..578: mol_type = other DNA

SEQ ID NO: 5744 - DNA, 488 bp, synthetic construct; identical to SEQ ID NO: 1947
  misc_feature 1..488: note = Synthetic polypeptide
  source 1..488: mol_type = other DNA

SEQ ID NO: 5745 - DNA, 479 bp, synthetic construct; identical to SEQ ID NO: 1948
  misc_feature 1..479: note = Synthetic polypeptide
  source 1..479: mol_type = other DNA

SEQ ID NO: 5746 - DNA, 470 bp, synthetic construct; identical to SEQ ID NO: 1949
  misc_feature 1..470: note = Synthetic polypeptide
  source 1..470: mol_type = other DNA

SEQ ID NO: 5747 - DNA, 576 bp, synthetic construct
  misc_feature 1..576: note = Synthetic polypeptide
  source 1..576: mol_type = other DNA
atgggggctaaccagttagtggtgctcaacgtgtacgacatgtattggatgaacgaatatacctcatccattggaattggagtttttcattcaggaattgaagtctatggcagagaatttgcttatggtggccatccttaccccttttctggaatatttgaaatttccccaggaaatgcttctgaactaggagaaacatttaaatttaaagaagctgttgttttagggagcacggacttcctagaagatgatatagaaaaaattgtagaagaactgggaaaagaatacaaaggcaatgcttatcatttaatgcataaaaactgcaatcatttttcttcagctttatcagagatgctgcaagcactttgaattcaaacagcctgctgagcctgtgctcaaacctatgagagcagggagtggcctcagctcctgcacttcccacacggaacacctccagatgtcatccacagtcgtgaggctgataacctgatgtcatggaccaacatggaactgactgtcttcaggtagtccctctgaaacaaaaactcaaactaagttttcaggctggagtggaaa

SEQ ID NO: 5748 - DNA, 477 bp, synthetic construct
  misc_feature 1..477: note = Synthetic polypeptide
  source 1..477: mol_type = other DNA
atgggggctaaccagttagtggtgctcaacgtgtacgacatgtattggatgaacgaatatacctcatccattggaattggagtttttcattcaggaattgaagtctatggcagagctgttgttttagggagcacggacttcctagaagatgatatagaaaaaattgtagaagaactgggaaaagaatacaaaggcaatgcttatcatttaatgcataaaaactgcaatcatttttcttcagctttatcagagatgctgcaagcactttgaattcaaacagcctgctgagcctgtgctcaaacctatgagagcagggagtggcctcagctcctgcacttcccacacggaacacctccagatgtcatccacagtcgtgaggctgataacctgatgtcatggaccaacatggaactgactgtcttcaggtagtccctctgaaacaaaaactcaaactaagttttcaggctggagtggaaa

SEQ ID NO: 5749 - DNA, 1178 bp, synthetic construct; identical to SEQ ID NO: 1256
  misc_feature 1..1178: note = Synthetic polypeptide
  source 1..1178: mol_type = other DNA

SEQ ID NO: 5750 - DNA, 947 bp, synthetic construct; identical to SEQ ID NO: 1257
  misc_feature 1..947: note = Synthetic polypeptide
  source 1..947: mol_type = other DNA

SEQ ID NO: 5751 - DNA, 857 bp, synthetic construct; identical to SEQ ID NO: 1258
  misc_feature 1..857: note = Synthetic polypeptide
  source 1..857: mol_type = other DNA

SEQ ID NO: 5752 - DNA, 285 bp, synthetic construct; identical to SEQ ID NO: 4104
  misc_feature 1..285: note = Synthetic polypeptide
  source 1..285: mol_type = other DNA

SEQ ID NO: 5753 - DNA, 370 bp, synthetic construct; identical to SEQ ID NO: 4105
  misc_feature 1..370: note = Synthetic polypeptide
  source 1..370: mol_type = other DNA

SEQ ID NO: 5754 - DNA, 250 bp, synthetic construct; identical to SEQ ID NO: 4106
  misc_feature 1..250: note = Synthetic polypeptide
  source 1..250: mol_type = other DNA

SEQ ID NO: 5755 - DNA, 400 bp, synthetic construct; identical to SEQ ID NO: 4107
  misc_feature 1..400: note = Synthetic polypeptide
  source 1..400: mol_type = other DNA

SEQ ID NO: 5756 - DNA, 403 bp, synthetic construct; identical to SEQ ID NO: 4108
  misc_feature 1..403: note = Synthetic polypeptide
  source 1..403: mol_type = other DNA

SEQ ID NO: 5757 - DNA, 1445 bp, synthetic construct
  misc_feature 1..1445: note = Synthetic polypeptide
  source 1..1445: mol_type = other DNA
atggcggcgcccaggccgccgcctgccaggctgtcgggcgtcatggtgccggcgcccatccaagacctggaggccctgcgcgcgctcacggcgctcttcaaagagcagcggaaccggaacttggatacgattggtgttgctgttgatttgattcttctgtttcgtgaactgcgagtggaacaggaatctctgttgacagcttttcgctgtggcctgcagtttttaggcaacattgcctcacggaatgaagattcccagtctattgtttgggtgcatgctttcccagaactgtttttgtcttgcttaaatcatccggacaaaaaaattgttgcctactcttcaatgattttgtttacatcccttaatcatgaaagaatgaaagaactggaggagaacctcaatattgcaattgatgtcatagatgcttaccaaaaacatcctgaatcagaatggccgttcttgattattacagacctctttctgaaaagcccggaattggtacaagccatgtttcccaaactgaacaatcaagaaagagttacactgttagaccttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggaggcactggctacaattaggcttctcgacgtcctgtgcgaaatgactgtgaatactgagctgctcggctatctgcaggttttccctggcttgctggaaagagtgattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggaacaaggcaagaatttctgctctcaccactccagtaaacaacgtgctgaaggtccagagcaactcactaagccaagaaaaatcagatgcatgcaggttggaaagaagtaaaactggctttattcataaatgaggtgatcgtgtgtgttaaggaactgataaagttatgagaagtgaattttgaatggttacaagatatgtaaatgaaaattaattatataaaactagcaaataataataagaaaaaatttaaatgccacatacaatagcatcataaaacatgaaatatttaggaataaactttaacgaaatatgtgcaagacctatactctgaaaaccataaaacattgctgagagaagttaaaatttaacagacagctcaatattgttaagtgttagatctccccaagttgacctctatagagtgaatgctataccagtcagaatgccaggagacatttgtg

SEQ ID NO: 5758 - DNA, 1637 bp, synthetic construct
  misc_feature 1..1637: note = Synthetic polypeptide
  source 1..1637: mol_type = other DNA
atggcggcgcccaggccgccgcctgccaggctgtcgggcgtcatggtgccggcgcccatccaagacctggaggccctgcgcgcgctcacggcgctcttcaaagagcagcggaaccgagaaacagcacccaggactatcttccaaagagttctggatatcctaaagaaatcttctcatgctgttgagcttgcctgcagagatccatcccaagtggaaaacctggcttccagtctgcagttaataacagaatgcttcaggtgtcttcgcaatgcttgcatagagtgttctgtgaaccagaattcaatcaggaacttggatacgattggtgttgctgttgatttgattcttctgtttcgtgaactgcgagtggaacaggaatctctgttgacagcttttcgctgtggcctgcagtttttaggcaacattgcctcacggaatgaagattcccagtctattgtttgggtgcatgctttcccagaactgtttttgtcttgcttaaatcatccggacaaaaaaattgttgcctactcttcaatgattttgtttacatcccttaatcatgaaagaatgaaagaactggaggagaacctcaatattgcaattgatgtcatagatgcttaccaaaaacatcctgaatcagaatggccgttcttgattattacagacctctttctgaaaagcccggaattggtacaagccatgtttcccaaactgaacaatcaagaaagagttacactgttagaccttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggaggcactggctacaattaggcttctcgacgtcctgtgcgaaatgactgtgaatactgagctgctcggctatctgcaggttttccctggcttgctggaaagagtgattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggaacaaggcaagaatttctgctctcaccactccagtaaacaacgtgctgaaggtccagagcaactcactaagccaagaaaaatcagatgcatgcaggttggaaagaagtaaaactggctttattcataaatgaggtgatcgtgtgtgttaaggaactgataaagttatgagaagtgaattttgaatggttacaagatatgtaaatgaaaattaattatataaaactagcaaataataataagaaaaaatttaaatgccacatacaatagcatcataaaacatgaaatatttaggaataaactttaacgaaatatgtgcaagacctatactctgaaaaccataaaacattgctgagagaagttaaaatttaacagacagctcaatattgttaagtgttagatctccccaagttgacctctatagagtgaatgctataccagtcagaatgccaggagacatttgtg

SEQ ID NO: 5759 - DNA, 893 bp, synthetic construct
  misc_feature 1..893: note = Synthetic polypeptide
  source 1..893: mol_type = other DNA
cttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggaggcactggctacaattaggcttctcgacgtcctgtgcgaaatgactgtgaatactgagctgctcggctatctgcaggttttccctggcttgctggaaagagtgattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggaacaaggcaagaatttctgctctcaccactccagtaaacaacgtgctgaaggtccagagcaactcactaagccaagaaaaatcagatgcatgcaggttggaaagaagtaaaactggctttattcataaatgaggtgatcgtgtgtgttaaggaactgataaagttatgagaagtgaattttgaatggttacaagatatgtaaatgaaaattaattatataaaactagcaaataataataagaaaaaatttaaatgccacatacaatagcatcataaaacatgaaatatttaggaataaactttaacgaaatatgtgcaagacctatactctgaaaaccataaaacattgctgagagaagttaaaatttaacagacagctcaatattgttaagtgttagatctccccaagttgacctctatagagtgaatgctataccagtcagaatgccaggagacatttgtg

SEQ ID NO: 5760 - DNA, 735 bp, synthetic construct
  misc_feature 1..735: note = Synthetic polypeptide
  source 1..735: mol_type = other DNA
ggctacaattaggcttctcgacgtcctgtgcgaaatgactgtgaatactgagctgctcggctatctgcaggttttccctggcttgctggaaagagtgattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggaacaaggcaagaatttctgctctcaccactccagtaaacaacgtgctgaaggtccagagcaactcactaagccaagaaaaatcagatgcatgcaggttggaaagaagtaaaactggctttattcataaatgaggtgatcgtgtgtgttaaggaactgataaagttatgagaagtgaattttgaatggttacaagatatgtaaatgaaaattaattatataaaactagcaaataataataagaaaaaatttaaatgccacatacaatagcatcataaaacatgaaatatttaggaataaactttaacgaaatatgtgcaagacctatactctgaaaaccataaaacattgctgagagaagttaaaatttaacagacagctcaatattgttaagtgttagatctccccaagttgacctctatagagtgaatgctataccagtcagaatgccaggagacatttgtg

SEQ ID NO: 5761 - DNA, 454 bp, synthetic construct; identical to SEQ ID NO: 2297
  misc_feature 1..454: note = Synthetic polypeptide
  source 1..454: mol_type = other DNA

SEQ ID NO: 5762 - DNA, 412 bp, synthetic construct; identical to SEQ ID NO: 1704
  misc_feature 1..412: note = Synthetic polypeptide
  source 1..412: mol_type = other DNA

SEQ ID NO: 5763 - DNA, 1213 bp, synthetic construct; identical to SEQ ID NO: 1093
  misc_feature 1..1213: note = Synthetic polypeptide
  source 1..1213: mol_type = other DNA

SEQ ID NO: 5764 - DNA, 616 bp, synthetic construct; identical to SEQ ID NO: 1094
  misc_feature 1..616: note = Synthetic polypeptide
  source 1..616: mol_type = other DNA

SEQ ID NO: 5765 - DNA, 868 bp, synthetic construct; identical to SEQ ID NO: 1095
  misc_feature 1..868: note = Synthetic polypeptide
  source 1..868: mol_type = other DNA

SEQ ID NO: 5766 - DNA, 581 bp, synthetic construct; identical to SEQ ID NO: 4675
  misc_feature 1..581: note = Synthetic polypeptide
  source 1..581: mol_type = other DNA

SEQ ID NO: 5767 - DNA, 384 bp, synthetic construct
  misc_feature 1..384: note = Synthetic polypeptide
  source 1..384: mol_type = other DNA
atggagcaagtggagatcctgaggaaattcatccagagggtccaggccatgaagagtcctgaccacaatggggaggacaacttcgcccgggacttcatgcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatt

SEQ ID NO: 5768 - DNA, 27 bp, synthetic construct
  misc_feature 1..27: note = Synthetic polypeptide
  source 1..27: mol_type = other DNA
atgatatgggagtataatgttgtgatt

SEQ ID NO: 5769 - DNA, 272 bp, synthetic construct
  misc_feature 1..272: note = Synthetic polypeptide
  source 1..272: mol_type = other DNA
tgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatt

SEQ ID NO: 5770 - DNA, 910 bp, synthetic construct
  misc_feature 1..910: note = Synthetic polypeptide
  source 1..910: mol_type = other DNA
atgctctcgggcatagaggcggcggcaggggaatatgaggactcggagctgcggtgccgcgtggctgtggaggagctgagcccgggcgggcagccgcgaaggcgccaggccctgcgcaccgcggagctgagcctgggtcgcaacgagcgccgcgagttgatgctgcggctgcaagcgccagggcccgcggggcggccgcgctgctttcctctgcgcgccgcgcgcctcttcacgcgtttcgccgaggccgggcgcagcaccctgcggctccccgcccacgacacccccggggccggcgcagtgcagctgctgctctcggactgccccccagaccgcctgcgccgcttcctgcgcacattgcgcctcaagctggctgcggccccgggtcccgggccggcctccgcccgagcgcagctgctgggcccgcggccccgcgacttcgtcaccatcagccctgtgcagcccgaggagcggcggctcagggcggccacccgggttccggacactacgctggtgaagcggcctgtggagccccaggctggggccgagcctagcacagaagccccaaggtggcccctgcctgtgaagaggctgagcttgccctccaccaagccacagctttctgaggaacaggctgctgtgctgagggccgtcctgaaaggccagagcatcttcttcactgggagtgcaggaacagggaagtcatatctgctaaagcgaatcctgggctcactgccccccacaggcactgtggccactgccagcactggggtggcagcctgccacatcgggggcaccaccctccatgcctttgcaggaggccaaggtgggaggatcgcttgagcccaggagtttgagaccagcctggccaacacagtaaaccctgtctccacaaaatttaaaaattagc

SEQ ID NO: 5771 - DNA, 247 bp, synthetic construct
  misc_feature 1..247: note = Synthetic polypeptide
  source 1..247: mol_type = other DNA
atgtatggggtctttgtgcggattctgactgagcgttcacagaggaaggcgttcctgcaggcccggagctgcattgaggaccgactgaggctggaggatgagaacgagaagcaggagcggctcctcatgagcctcctgccccggaacgttgccatggagatgaaggaggacttcctgaagccccctgagaggattttccacaagatttacatccagaggcacgacaatgtgaggagagaaagggttg

SEQ ID NO: 5772 - DNA, 922 bp, synthetic construct
  misc_feature 1..922: note = Synthetic polypeptide
  source 1..922: mol_type = other DNA
atggcgggggcgccgcgcggcggaggcggcggcggaggcggcgcgggcgagcccgggggcgccgagcgggcggccgggacaagccgccggcgcgggctccgggcgtgcgacgaggagttcgcttgcccagagctggaggcgctgttccgcggctacacgctgcggctggagcaggcggccacgctgaaggcgctggccgttctcagcctgctggcgggcgcgctggcgctggccgagctgctgggcgcgccggggcccgcgcccggcctggccaagggctcacacccggtgcactgcgtcctcttcctggcgctgctcgtggtaaccaacgtccggtccctgcaggtgccccagctgcagcaggtcggccagctggcgctgctcttcagcctcaccttcgcgctgctctgctgtcctttcgcgctgggcggccccgcccggggttccgccggggccgctggggggccagcgaccgccgaacaaggggtttggcagctccttttggtcaccttcgtgtcctatgccttgctgcccgtgcgcagcctgctggccataggctttgggctcgtggtggctgcgtcgcacttgctggtcacagccaccttggtccccgccaagcgcccacgtctctggaggacgctcggtgccaatgccttgctcttcgtcggtgtgaacatgtatggggtctttgtgcggattctgactgagcgttcacagaggaaggcgttcctgcaggcccggagctgcattgaggaccgactgaggctggaggatgagaacgagaagcaggagcggctcctcatgagcctcctgccccggaacgttgccatggagatgaaggaggacttcctgaagccccctgagaggattttccacaagatttacatccagaggcacgacaatgtgaggagagaaagggttg

SEQ ID NO: 5773 - DNA, 2138 bp, synthetic construct; identical to SEQ ID NO: 1775
  misc_feature 1..2138: note = Synthetic polypeptide
  source 1..2138: mol_type = other DNA

SEQ ID NO: 5774 - DNA, 688 bp, synthetic construct; identical to SEQ ID NO: 1776
  misc_feature 1..688: note = Synthetic polypeptide
  source 1..688: mol_type = other DNA

SEQ ID NO: 5775 - DNA, 625 bp, synthetic construct; identical to SEQ ID NO: 1777
  misc_feature 1..625: note = Synthetic polypeptide
  source 1..625: mol_type = other DNA

SEQ ID NO: 5776 - DNA, 1655 bp, synthetic construct; identical to SEQ ID NO: 2605
  misc_feature 1..1655: note = Synthetic polypeptide
  source 1..1655: mol_type = other DNA

SEQ ID NO: 5777 - DNA, 2153 bp, synthetic construct; identical to SEQ ID NO: 217
  misc_feature 1..2153: note = Synthetic polypeptide
  source 1..2153: mol_type = other DNA

SEQ ID NO: 5778 - DNA, 1664 bp, synthetic construct; identical to SEQ ID NO: 222
  misc_feature 1..1664: note = Synthetic polypeptide
  source 1..1664: mol_type = other DNA

SEQ ID NO: 5779 - DNA, 1766 bp, synthetic construct; identical to SEQ ID NO: 221
  misc_feature 1..1766: note = Synthetic polypeptide
  source 1..1766: mol_type = other DNA

SEQ ID NO: 5780 - DNA, 1736 bp, synthetic construct; identical to SEQ ID NO: 156
  misc_feature 1..1736: note = Synthetic polypeptide
  source 1..1736: mol_type = other DNA

SEQ ID NO: 5781 - DNA, 1724 bp, synthetic construct; identical to SEQ ID NO: 157
  misc_feature 1..1724: note = Synthetic polypeptide
  source 1..1724: mol_type = other DNA

SEQ ID NO: 5782 - DNA, 632 bp, synthetic construct; identical to SEQ ID NO: 4501
  misc_feature 1..632: note = Synthetic polypeptide
  source 1..632: mol_type = other DNA

SEQ ID NO: 5783 - DNA, 1747 bp, synthetic construct; identical to SEQ ID NO: 1612
  misc_feature 1..1747: note = Synthetic polypeptide
  source 1..1747: mol_type = other DNA

SEQ ID NO: 5784 - DNA, 1762 bp, synthetic construct; identical to SEQ ID NO: 1613
  misc_feature 1..1762: note = Synthetic polypeptide
  source 1..1762: mol_type = other DNA

SEQ ID NO: 5785 - DNA, 624 bp, synthetic construct; identical to SEQ ID NO: 1614
  misc_feature 1..624: note = Synthetic polypeptide
  source 1..624: mol_type = other DNA

SEQ ID NO: 5786 - DNA, 1893 bp, synthetic construct; identical to SEQ ID NO: 5559
  misc_feature 1..1893: note = Synthetic polypeptide
  source 1..1893: mol_type = other DNA

SEQ ID NO: 5787 - DNA, 57 bp, synthetic construct
  misc_feature 1..57: note = Synthetic polypeptide
  source 1..57: mol_type = other DNA
atggctcttcctcagcaccactgggttagggtctccctgactgagctggtctcggca

SEQ ID NO: 5788 - DNA, 57 bp, synthetic construct; identical to SEQ ID NO: 5787
  misc_feature 1..57: note = Synthetic polypeptide
  source 1..57: mol_type = other DNA

SEQ ID NO: 5789 - DNA, 1329 bp, synthetic construct
  misc_feature 1..1329: note = Synthetic polypeptide
  source 1..1329: mol_type = other DNA
atggacatgatgctgttggtgcagggtgcttgttgctcgaaccagtggctggcggcggtgctcctcagcctgtgctgcctgctaccctcctgcctcccggctggacagagtgtggacttcccctgggcggccgtggacaacatgatggtcagaaaaggggacacggcggtgcttaggtgttatttggaagatggagcttcaaagggtgcctggctgaaccggtcaagtattatttttgcgggaggtgataagtggtcagtggatcctcgagtttcaatttcaacattgaataaaagggactacagcctccagatacagaatgtagatgtgacagatgatggcccatacacgtgttctgttcagactcaacatacacccagaacaatgcaggtgcatctaactgtgcaagttcctcctaagatatatgacatctcaaatgatatgaccgtcaatgaaggaaccaacgtcactcttacttgtttggccactgggaaaccagagccttccatttcttggcgacacatctccccatcagcaaaaccatttgaaaatggacaatatttggacatttatggaattacaagggaccaggctggggaatatgaatgcagtgcggaaaatgatgtgtcattcccagatgtgaggaaagtaaaagttgttgtcaactatcagggaaaagacttgaacatcagcatctcatactgaacctttcaatagaggctcttaccattgtagtaaaaaggagaataaataaaaagcataagaactgaaaaaggaaaataaaaagctgccaaattgcctctatgtgtggctgatttatgttctgcattgtggatgatattgtgttctgtactgtaaaaccaaaaaaaattatttcaattaataagagtttagcagtgatgctgaataaaccagtaacaatcagaaattataatttttacatttaatttacaatggcaaatatatgtaaaattatatcagagaaaatgtgcaaatcttttataaaaaagattattaaaatgaatttaagagatgttaaatgaaaagtatactatatttttgatatgaaaagtcattataaatgtagtaaaaatgttgattgtcctcaaattgatctgtgaattaaatacaatttcattcaaaatttgaacaggtattttgttgaactttaaaaactgattctaaaattaacatgaaaaagcaagaattcgagaagactccatccattcctaaagaagcatggatagacaggataacatcattgtaattatacaatgtgatgttagtagaaggaaagataaatagagcaatagagagacaagaaacaaa

SEQ ID NO: 5790 - DNA, 945 bp, synthetic construct
  misc_feature 1..945: note = Synthetic polypeptide
  source 1..945: mol_type = other DNA
atgcaggtgcatctaactgtgcaagttcctcctaagatatatgacatctcaaatgatatgaccgtcaatgaaggaaccaacgtcactcttacttgtttggccactgggaaaccagagccttccatttcttggcgacacatctccccatcagcaaaaccatttgaaaatggacaatatttggacatttatggaattacaagggaccaggctggggaatatgaatgcagtgcggaaaatgatgtgtcattcccagatgtgaggaaagtaaaagttgttgtcaactatcagggaaaagacttgaacatcagcatctcatactgaacctttcaatagaggctcttaccattgtagtaaaaaggagaataaataaaaagcataagaactgaaaaaggaaaataaaaagctgccaaattgcctctatgtgtggctgatttatgttctgcattgtggatgatattgtgttctgtactgtaaaaccaaaaaaaattatttcaattaataagagtttagcagtgatgctgaataaaccagtaacaatcagaaattataatttttacatttaatttacaatggcaaatatatgtaaaattatatcagagaaaatgtgcaaatcttttataaaaaagattattaaaatgaatttaagagatgttaaatgaaaagtatactatatttttgatatgaaaagtcattataaatgtagtaaaaatgttgattgtcctcaaattgatctgtgaattaaatacaatttcattcaaaatttgaacaggtattttgttgaactttaaaaactgattctaaaattaacatgaaaaagcaagaattcgagaagactccatccattcctaaagaagcatggatagacaggataacatcattgtaattatacaatgtgatgttagtagaaggaaagataaatagagcaatagagagacaagaaacaaa

SEQ ID NO: 5791 - DNA, 2696 bp, synthetic construct
  misc_feature 1..2696: note = Synthetic polypeptide
  source 1..2696: mol_type = other DNA
atgaaaatgaaaatacagaaaaaagagaagcagttgtcaaatttaaaagttttgaatcactccccaatgtctgatgcctctgtcaattttgactacaaatctccatccccatttgactgcagcactgatcaagaagagaaaattgaagatgttgctagtcactgtctgcctcagaaggacctgtatactgctgaagaggaagctgctaccctttttcctaggaaaatgacatcccataatgggatggaggacagtggaggaggaggtactggagtgaagaagaaacggaagaaaaaggagccaggagaccaagagggtgcagcaaagggaagcaaggacagagagcccaagccaaagaggaaacgagaaccgaaagagccaaaggaacccagaaaggccaaggagccgaagaaggccaaggagcacaaggagccgaagcaaaaagatggggcaaagaaggcacggaagccccgggaggcctcgggcaccaaggaggccaaagagaagaggagctgcactgactctgcagccaggacgaagtccaggaaggccagcaaggagcaaggaccaaccccagtggagaaaaagaagaaaggaaaaaggaaaagtgaaactacagtggagagtttagagctggatcagggcctgacgaacccatctctgcggagtcctgaggagtccactgagtctacagacagccagaaacgacgctcgggaaggcaagtaaagcgcagaaaatacaatgaggacctggacttcaaagtggtggatgatgatggggaaacaattgctgttcttggagctggtcgaacatctgcactctcagcctctacactggcctggcaggcggaggagcctccagaagatgatgcaaacatcattgagaagatcctggcatctaagactgtccaggaggttcacccaggagaacctccgttcgacttggagctgttctacgttaagtatagaaatttttcctacttacattgtaaatgggccacaatggaagagctcgaaaaggatcctcgcatcgcacagaagatcaagcgatttaggaataaacaagcccagatgaagcacatttttacggagcctgatgaagacttgttcaatccagactatgtagaagttgatcgcatcttggaggtggcccacaccaaggatgcagaaacaggggaggaggtaacacattacctggtgaagtggtgctcactaccatatgaagaaagcacgtgggagctagaggaagatgtagatcctgcaaaagttaaagaatttgaatctcttcaagttctccctgaaattaagcatgtggagcggcctgcttcagactcctggcagaaacttgagaagtctcgcgagtataagaacagtaaccagctccgggagtaccagctggaagggatgaactggcttctttttaactggtataacagaaaaaactgtattttggctgatgagatgggcctagggaaaaccatccagtccatcacattcctttcagaaatatttctgagaggaatccacggcccttttctcattatcgcccctctctccaccatcactaactgggagcgggagttccggacatggacagagatgaatgccattgtgtaccacggcagccagatcagcaggcagatgatccagcagtatgaaatggtgtacagagacgcccagggaaaccccctttcaggagtcttcaagttccacgtcgtcatcacaacatttgaaatgatcctagcagactgcccagagttgaagaagattcactggagctgtgtgataattgatgaagcccacagactgaagaataggaactgcaaacttctggagggtctaaagcttatggccctggaacataaagtgcttctcactggaacacccttgcagaactctgtggaggagctcttcagtttgttaaattttctggagccatcacagtttccttcagagaccgctttcttggaggaatttggagatctgaaaacagaggagcaggtaaagaaactgcagtctatcctaaaaccaatgatgcttcggcggctgaaagatgatgtggaaaagaaccttgctcccaaacaagagacgatcattgaggtggaactgaccaatatccagaaaaagtactaccgtgccatcctcgagaagaacttttccttcctgaccaagggggcaaatcagcacaacatgcccaatctcatcaacaccatgatggagctgaggaagtgctgtaaccatccctacctgatcaatggagcagaggagaaaattctagaagatttccgaaaaacccacagccctgatgcccctgactttcagctgcaggccatgattcaggcagcaggaaagcttgtgttgattgataaactactccctaagctgattgcaggtggccacaaagtactcatcttctcccagatggtgcgctgcctcgacatcctagaagattacctcatccagagaagatacacctatgagcgaattgatgggcgagtacggggaaacctgcgccaggcagccatcgaccggttctgtaagccagattcagaccgctttgtctttcttctgtgcaccagagcgggaggcctggggatcaatctcacagctgctgatacctgcatcatatttgattctgactggaacccacaaaatgacttgcaggtgattgatcaaaagaagtttggaggctgctg

SEQ ID NO: 5792 - DNA, 756 bp, synthetic construct; identical to SEQ ID NO: 1387
  misc_feature 1..756: note = Synthetic polypeptide
  source 1..756: mol_type = other DNA

SEQ ID NO: 5793 - DNA, 1389 bp, synthetic construct; identical to SEQ ID NO: 1388
  misc_feature 1..1389: note = Synthetic polypeptide
  source 1..1389: mol_type = other DNA

SEQ ID NO: 5794 - DNA, 582 bp, synthetic construct; identical to SEQ ID NO: 4738
  misc_feature 1..582: note = Synthetic polypeptide
  source 1..582: mol_type = other DNA

SEQ ID NO: 5795 - DNA, 546 bp, synthetic construct; identical to SEQ ID NO: 4739
  misc_feature 1..546: note = Synthetic polypeptide
  source 1..546: mol_type = other DNA

SEQ ID NO: 5796 - DNA, 567 bp, synthetic construct; identical to SEQ ID NO: 4740
  misc_feature 1..567: note = Synthetic polypeptide
  source 1..567: mol_type = other DNA

SEQ ID NO: 5797 - DNA, 552 bp, synthetic construct; identical to SEQ ID NO: 4741
  misc_feature 1..552: note = Synthetic polypeptide
  source 1..552: mol_type = other DNA

SEQ ID NO: 5798 - DNA, 597 bp, synthetic construct; identical to SEQ ID NO: 4742
  misc_feature 1..597: note = Synthetic polypeptide
  source 1..597: mol_type = other DNA

SEQ ID NO: 5799 - DNA, 1137 bp, synthetic construct
  misc_feature 1..1137: note = Synthetic polypeptide
  source 1..1137: mol_type = other DNA
atggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctggcggtggttattatgggtgtggtgctacaaggtgccaacctgtatggttacatcaggtgtaaggtgcgcagcagaaagcatttaaccagcatggctacttcatattttggaaagcagtttttaagacaattttcaacaacaacaaaagatgtgaagaaacagcaattacagccgcctatatatgggggaaaaaacttagaaaacagaaaccatccctgagaaaacccagacattagatctattaaacaaaaagtttgtcaacctttaaatatgctttaaaaactaaagtaaaccgtggacaaagaacaggagaaaggaaaataatgtataaacaaagtgaaagtatcagtaaatagaaaacatgaaaaattctggagctgaaaaatttcttagaggggtttacagatttaaacaggcagaagaatcagcaaatttgaaaataggacaaatgtaattatccagtccgaggaacagaaagaaaaaagaatgaagagtgaacagagcttgagggatctgtggcattttatcaagttaccaacatacgcattaaaggagttccagaaaatgaaaagaaaaaggcagaaataatatttgaggaaataatggctgagacttcccaaattcaatgaaatacatgagctacacattcaagaagatcaacaaattataactaggataaactcagagatctattactaaacacattacaatcaagctgtcaaaagccagagacaaagacagtcgttaaagcagcaggagaaaaacaacttatcacatacaagggatcctgtgtaagattaaatgcctaccactcatcagaaactacagaggtcagaaggctgtagaatgacatattcaaagtgctaaaagaaaaaaacttaacagagaattttagatccagcaaaactatccttcaaaactataagaaaggat

SEQ ID NO: 5800 - DNA, 1203 bp, synthetic construct
  misc_feature 1..1203: note = Synthetic polypeptide
  source 1..1203: mol_type = other DNA
atggttacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctggcggtggttattatgggtgtggtgctacaaggtgccaacctgtatggttacatcaggtgtaaggtgcgcagcagaaagcatttaaccagcatggctacttcatattttggaaagcagtttttaagacaattttcaacaacaacaaaagatgtgaagaaacagcaattacagccgcctatatatgggggaaaaaacttagaaaacagaaaccatccctgagaaaacccagacattagatctattaaacaaaaagtttgtcaacctttaaatatgctttaaaaactaaagtaaaccgtggacaaagaacaggagaaaggaaaataatgtataaacaaagtgaaagtatcagtaaatagaaaacatgaaaaattctggagctgaaaaatttcttagaggggtttacagatttaaacaggcagaagaatcagcaaatttgaaaataggacaaatgtaattatccagtccgaggaacagaaagaaaaaagaatgaagagtgaacagagcttgagggatctgtggcattttatcaagttaccaacatacgcattaaaggagttccagaaaatgaaaagaaaaaggcagaaataatatttgaggaaataatggctgagacttcccaaattcaatgaaatacatgagctacacattcaagaagatcaacaaattataactaggataaactcagagatctattactaaacacattacaatcaagctgtcaaaagccagagacaaagacagtcgttaaagcagcaggagaaaaacaacttatcacatacaagggatcctgtgtaagattaaatgcctaccactcatcagaaactacagaggtcagaaggctgtagaatgacatattcaaagtgctaaaagaaaaaaacttaacagagaattttagatccagcaaaactatccttcaaaactataagaaaggat

SEQ ID NO: 5801 - DNA, 1395 bp, synthetic construct
  misc_feature 1..1395: note = Synthetic polypeptide
  source 1..1395: mol_type = other DNA
atgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctgtcttctctgtgagttgctcagcagcagctttattacctgtatggttacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctggcggtggttattatgggtgtggtgctacaaggtgccaacctgtatggttacatcaggtgtaaggtgcgcagcagaaagcatttaaccagcatggctacttcatattttggaaagcagtttttaagacaattttcaacaacaacaaaagatgtgaagaaacagcaattacagccgcctatatatgggggaaaaaacttagaaaacagaaaccatccctgagaaaacccagacattagatctattaaacaaaaagtttgtcaacctttaaatatgctttaaaaactaaagtaaaccgtggacaaagaacaggagaaaggaaaataatgtataaacaaagtgaaagtatcagtaaatagaaaacatgaaaaattctggagctgaaaaatttcttagaggggtttacagatttaaacaggcagaagaatcagcaaatttgaaaataggacaaatgtaattatccagtccgaggaacagaaagaaaaaagaatgaagagtgaacagagcttgagggatctgtggcattttatcaagttaccaacatacgcattaaaggagttccagaaaatgaaaagaaaaaggcagaaataatatttgaggaaataatggctgagacttcccaaattcaatgaaatacatgagctacacattcaagaagatcaacaaattataactaggataaactcagagatctattactaaacacattacaatcaagctgtcaaaagccagagacaaagacagtcgttaaagcagcaggagaaaaacaacttatcacatacaagggatcctgtgtaagattaaatgcctaccactcatcagaaactacagaggtcagaaggctgtagaatgacatattcaaagtgctaaaagaaaaaaacttaacagagaattttagatccagcaaaactatccttcaaaactataagaaaggat

SEQ ID NO: 5802 - DNA, 763 bp, synthetic construct; identical to SEQ ID NO: 261
  misc_feature 1..763: note = Synthetic polypeptide
  source 1..763: mol_type = other DNA

SEQ ID NO: 5803 - DNA, 646 bp, synthetic construct; identical to SEQ ID NO: 262
  misc_feature 1..646: note = Synthetic polypeptide
  source 1..646: mol_type = other DNA

SEQ ID NO: 5804 - DNA, 303 bp, synthetic construct; identical to SEQ ID NO: 148
  misc_feature 1..303: note = Synthetic polypeptide
  source 1..303: mol_type = other DNA

SEQ ID NO: 5805 - DNA, 301 bp, synthetic construct; identical to SEQ ID NO: 147
  misc_feature 1..301: note = Synthetic polypeptide
  source 1..301: mol_type = other DNA

SEQ ID NO: 5806 - DNA, 593 bp, synthetic construct
  misc_feature 1..593: note = Synthetic polypeptide
  source 1..593: mol_type = other DNA
atgtcagctcagtgctgtgcgggccagctggcctgctgctgtgggtctgcaggctgctctctctgctgtgattgctgccccaggattcggcagtccctcagcacccgcttcatgtacgccctctacttcattctggtcgtcgtcctctgctgcatcatgatgtcaacaaccgtggctcacaagatgaaagagcacgtatatgcccagatggcctgaagtaactgaagaatcacaaaagaagtgaatgtgccctgccccgccttaactgatgacattccaccacaaaagaagtgtaaatggccggtccttgccttaagtgatgacattaccttgtgaaagtccttttcctgactcatccggggtcaaaaagctcccccactgagcaccttgcgactcccattcctgcccaccagagaacgaaccccctttgactgtaattttcctttacctgcccaaatcttataaaacggccccacccttatctccctttgctgactctcttttcggactcagcccgcctgcacccaggtgattaaaagcttttattgctcacacaagcctgtttggtggtcccttcacacggacgcgcatga

SEQ ID NO: 5807 - DNA, 1465 bp, synthetic construct
  misc_feature 1..1465: note = Synthetic polypeptide
  source 1..1465: mol_type = other DNA
atgttgctgttcctgtggatagaaacatccagtgaatactttaactttgactgggtcacttttctaggaacaggatactggtttttctggtctatttttattctgagtttagctaggatcctgactgcctactcttcattgctgttgttacttggatttttgttgctttgggaaaggattgaactatacctgcacttgtgtcataagatcctgattctgctagtgattcttctgtgtgtcattttaatgttcattatatgcaaattctggaaagaaaggtggctggtagctgggctgtcaatgcagatctttgctccctacgtgcacctggtcagcataactgtgatggttatccttttctggcctgtggccttctacgtggcatgtttggaaagagaagttagaatgagaagatacaggatgacacattctgagaaaaaaagactcaagcaatgtaatgtaatcacaaggttaagaggtctacaagtgcctgttggattaccctttcttcttatccttttaggtctctatttgatgccactggggatttattctccctgcattcaggagaaggagaatttggggcccaagccaaccatctttggacatagaggtgcacccatgttggggcctgagaataccatgatgtcctttgagaaagctgttgaacatggagcccatggattggagactgatatacacttaagttatgatcatgtgcctttcctcatgcatgactttgacctgaaaagaacaaccaatattggggaagttcagccagaatctgcctgcgagaaccctgccttcttcaactgggatttcctatcgactctgaatgcaggcaaatggtttgtaaaaccagagctcaggccattttacaatatgaaacctctatcagaggcagataaagaaagagcaagaaatcagtcaattccaacactagctgatttattgacacttgcagagaaggaaagaaaatttgtgatatttgatcttcatcgccctccaccaaaacatcctctcagacacacatttgtccgccaagtagtaagcgtgatccttgcctctaaaatcgagcaacatctgattttttggttgccagctcatgataggcaatacgtcaggtccgtggctcctggttttcagcatgtgggccgtttagtatccattgaaacccttgctaaaaacaatatcagtataataaatgttgactacaagaagttgttccctaatgggttaagagattataaagcagctaacatccatatcaacgtatacaccgtcaatgagccttggcttttctcactggcctggtgctccaggattaactcagtgaccacagacaacattgggctcctgagtcagcttgatcaccctcacttcttcatggtgtctagtgagacccagaaacctgtattactaaaagctgccccgggagacttggctgcacagccaggtttgagaa

SEQ ID NO: 5808 - DNA, 722 bp, synthetic construct
  misc_feature 1..722: note = Synthetic polypeptide
  source 1..722: mol_type = other DNA
atggcgcctcccgtccgtctcgagcgtccctttccttcccggcgctttcctgggttgcttctggcggccctggtgttgctgctgtcctccttctccgatcaatgcaatgtcccggaatggcttccatttgccaggcctaccaacctaactgatgactttgagtttcccattgggacatatctgaactatgaatgccgccctggttattccggaagaccgttttctatcatctgcctaaaaaactcagtctggacaagtgctaaggacaagtgcaaacgtaaatcatgtcgtaatcctccagatcctgtgaatggcatggcacatgtgatcaaagacatccagttcagatcccaaattaaatattcttgtcctaaaggataccgactcattggttcctcgtctgccacatgcatcatctcaggcaacactgtcatttgggataataaaacacctgtttgtgacagtgatgacattagggagtgaggcctttggaaggtgatgagatcatgagagcagagctgtcacgaatgggattagcgtcctaataaaagaggcccagaagagctcctttgcccctcctgccatgggaagaaatgctgaatctgccagagaggttggtcctgaactccttagcctccacaactatgagaaataaatttttgttgtgtatgagctaaccagtttatagtattttgttataacagcccaaatagactaagaca

SEQ ID NO: 5809 - DNA, 554 bp, synthetic construct
  misc_feature 1..554: note = Synthetic polypeptide
  source 1..554: mol_type = other DNA
attgggacatatctgaactatgaatgccgccctggttattccggaagaccgttttctatcatctgcctaaaaaactcagtctggacaagtgctaaggacaagtgcaaacgtaaatcatgtcgtaatcctccagatcctgtgaatggcatggcacatgtgatcaaagacatccagttcagatcccaaattaaatattcttgtcctaaaggataccgactcattggttcctcgtctgccacatgcatcatctcaggcaacactgtcatttgggataataaaacacctgtttgtgacagtgatgacattagggagtgaggcctttggaaggtgatgagatcatgagagcagagctgtcacgaatgggattagcgtcctaataaaagaggcccagaagagctcctttgcccctcctgccatgggaagaaatgctgaatctgccagagaggttggtcctgaactccttagcctccacaactatgagaaataaatttttgttgtgtatgagctaaccagtttatagtattttgttataacagcccaaatagactaagaca

SEQ ID NO: 5810 - DNA, 147 bp, synthetic construct
  misc_feature 1..147: note = Synthetic polypeptide
  source 1..147: mol_type = other DNA
atgctcttcaattcggtgctccgccagccccagcttggcgtcctgagaaatggttgggccctaatgccttcttgtctggattgtaagaagtctcccagatggcctcctagtttgtctgtcttcggtttattctccacattgctgcta

SEQ ID NO: 5811 - DNA, 98 bp, synthetic construct; identical to SEQ ID NO: 3114
  misc_feature 1..98: note = Synthetic polypeptide
  source 1..98: mol_type = other DNA

SEQ ID NO: 5812 - DNA, 5185 bp, synthetic construct
  misc_feature 1..5185: note = Synthetic polypeptide
  source 1..5185: mol_type = other DNA
atgggggaggactctccagtggctatgttcagctggtatttggacaacaccccaacagagcaggctgagcccctcctggatgcctgcagactcagaggattttggccaaggtccttaaccctcctccagagcaacacctccacgttgctgttgaacagctcgtttctgcagtcccggggagaggtcatccgaatcagagccacagcactgaccaggcatgcctatggggaggacacctatgtgatcagcactgtgcctccccgtgaggtgcctgcctgcactattgccccagaggagggcaccgttctgacgagctttgccatcttctgcaacgcctccacagccctgggacccctggagttctgcttctgtctggaatcaggttcctgcctacactgtggccctgaacctgccctcccatcagtgtatctgccacttggagaggagaacaatgactttgtgctgacagtagttatttctgccaccaatcgtgcaggggacacgcagcagacccaggccatggctaaggtggcactcggagacacatgtgttgaggatgtagcattccaggctgccgtgtcagagaaaatccccacagctctgcaaggcgagggtggccccgagcagctcctccagctggccaaggctgtgtcctccatgctgaaccaagagcatgaaagccagggctcaggacagtcactgagcatagacgtcagacagaaggtcagagagcatgtgctgggatcactgtctgcagtcaccaccggcttggaggacgtgcagagggtgcaggagctggccgaggtgctgagagaggtgacctgccggagtaaggaactcacaccctcggcccagtgggaggccagcttggctctacagcatgccagtgaggccctgttgacagtgagtgccaaggcccgccctgaggaccagaggcgccaggcagccaccagggacctgtttcaggctgtgggcagtgtgctggaagcttccctgagcaacagaccagaagagcctgcggaggccagcagcagccagattgccacagtgctgcggctgcttcgagtcatggagcatgtgcagaccaccctcctgctgggaaaactgccagggggccttccagccatgctggccaccccctccatctctgtgtacacaaacagaatacaaccctggagttggcaaggctcctccctgcgccctgatgccgcagactctgcaaccttcatgctgcccgctgcctcctccctcagctctctggagggcggccaggagcccgtggatataaagatcatgagtttcccaaagagcccctttccagcccgaagccactttgatgtcagcgggactgtcggtggcctccgtgtgaccagccctagtggtcaactcatacctgtgaagaatctgtcggagaatatcgagatcctgctgccccggcattcacaaagacacagccagccgaccgtgttgaacctgaccagtcctgaagctttgtgggtgaacgtgacttcaggggaggcaaccttggggatccagctgcactggagaccagacattgcactcacgcttagcctgggctatggctaccaccccaacaagagcagctacgatgcccaaactcacctcgtaccaatggtggctccagatgagctgcccacgtggatcctgagcccacaggacctgcgttttggagaaggggtctactatttgactgtggtccctgagtctgacctggagccagcccccggcagggacctcacggttggcatcaccaccttcctgtctcactgtgtgttctgggatgaggtccaggagacttgggacgactcaggatgccaggtggggcctcggaccagcccctaccagacacactgcctctgcaaccacctcactttcttcggaagcacgttcctggtgatgtccaatgccatcaacatccaccagactgctgagctctttgccacctttgaggacaaccctgtggtcgtgaccaccgtgggctgcctgtgtgtggtctacgtgctggtggtgatctgggcgaggaggaaggacgctcaggatcaggccaaggtgaaggtcacagtgctggaagacaatgatccctttgctcagtaccactacctggtgacagtctacacaggacaccgacgaggggcagccacgtcctcaaaggtgactgtcaccctgtatggcctggatggagagagagagccccaccacctggctgatcccgacactccggtttttgagcgaggagcagtggatgccttcctcctctccaccctgttccccctgggagaactgcggagcctccggctgtggcatgacaactcaggggaccggccatcgtggtatgtgagccgggtgctggtctatgacctggtgatggaccggaagtggtatttcctgtgcaactcctggctatccatcaatgttggagattgcgtcctcgataaggtgtttcctgtggccacggagcaggacagaaaacaattcagccacctgtttttcatgaagacttccgcgggcttccaggatggacacatctggtattcgatcttcagccgctgcgctcgcagcagcttcacccgcgtccagagggtgtcctgctgcttctccctgctgctgtgcaccatgctgaccagcatcatgttctggggggtccccaaggacccagctgagcaaaagatggacttgggtaaaattgaattcacctggcaggaggtgatgattggcctggagagctccatcctcatgttccccatcaacctcctgattgttcagatctttcagaacacccgtccccgggtcgcgaaggagcagaacactggaaaatgggaccgggggtcccccaacctgactccctccccacagcccatggaggacggccttctgacacctgaggcagtgaccaaggatgtgtcaagaatcgtcagctccctcttcaaagctctcaaggtgccatcccccgccttgggctgggactcagtgaacttgatggacatcaacagtctcctcgccttggtggaagatgtcatttatccacagaacacatcagggcaggtgttctgggaggaagccaaaaagagagaggaccctgtaacactcactttggggtcatcagaaatgaaagagaaatcacagtgtcccaagcccaaggcggcacggagtggcccctggaaggacagcgcctacaggcagtgtctgtaccttcagctggaacacgtggagcaagagctgcggctggtggggccccgaggcttctcccagccccacagccatgcctaggccctcaggcagctgcagaccctgaagggcggcctgggggtacagccgggcacctgggcccctgcacatgccagcgctcttcaggtgagcaaaccccctcaaggcctgccctggtggtgcatcctggtgggctggctcctggtagcggccaccagtggcgtggcggccttcttcaccatgctctacggcctgcactacgggagggccagctccctcaggtggctcatctccatggctgtctccttcgtggagagcatgttcgtcacccagcccctgaaggtgctgggattcgctgctttctttgcactggtcttgaagagagtggacgatgaggaggatactgtggccccgctgccaggacatctgttgggcccagacccctatgccttgttccgagcacgaagaaacagcagcagggatgtctaccagccacctctcaccgctgccattgagaagatgaaaaccacccacctcaaggaacagaaagcatttgccctcatcagagaaatcctggcatacttgggcttcctgtggatgctactgctcgtggcctacgggcagagggaccccagcgcctaccacctcaacagacacctccagcacagcttcaccaggggcttttcaggtgtgctcggcttccgagagttcttcaagtgggccaacaccaccctcgtgagtaacctgtatggtcaccccccaggctttatcactgatgggaactccaagctggttggcagtgcccagattcgtcaagtgagggtccaggaaagctcttgccctcttgcccagcagccgcaggcatatctcaacggatgccgtgcaccatattccctggatgctgaagacatggcagactatggggaaggctggaatgccaccaccctcagtaatggcagtaccagagccaggaccaacgtcaagggtatcccatctggggcaaactcactgtgtaccggggaggaggctacgtggtccccttggggactgatcgccaaagcacgtcaagaattctccgctatctctttgacaacacctggctggacgccctgaccagagctgtgtttgtggagtccactgtctacaacgccaacgtcaacctgttctgcattgtcacgctgacgctagagaccagcgctctgggcaccttttttacgcacgcggccctgcagagcctccgcctgtaccccttcaccgacggctggcaccccttcgtggtagcggcagagctcatctacttcctcttcctcctctactacatggtggtgcagggcaagcgcatgagtaaagagacgtggggctatttctgcagcaagtggaaccttctggagctggccatcatcctggccagctggagcgccctggcggtgtttgtgaagagggctgtcctggccgaaagggacctccagcgctgccggaaccacagggaggaaggcatcagcttcagtgagacagcagcagccgatgccgcccttggctacatcattgccttcctggtactcctgtccacagtgaagctttggcatctgctcaggttgaatcccaaaatgaacatgatcacggcagccctacgccgtgcctggggcgacatttcaggctttatgattgtcatccttaccatgctcctggcttactccatcgcgtcaaacttgatatttggttggaaactccgttcctacaaaaccctctttgatgcggcggagacgatggtcagccttcagctgggaatcttcaactacgaggaggtcctggactatagcccagtgcttggctccttcctcattggatcctgcattgtttttatgacatttgtggtgctgaacctgtttatctctgtcatcctggtggccttcagtgaggagcaaaaatactatcagagacttgaccatccgaggatttt

SEQ ID NO: 5813 - DNA, 7240 bp, synthetic construct
  misc_feature 1..7240: note = Synthetic polypeptide
  source 1..7240: mol_type = other DNA
atgagtgcagtgggcttggtactcctggtgcttgctctgaggcttagggccaccactgttaagccagaggaaggcagcttttgctctaacagccaggtggccttcagagatgcttgctatgaatttgtgccactcggacgcaccttccgtgatgcccagagctggtgcgaggggcaaggaggccatttggtcttcattcaggacgaaggcacccagtggtttctgcagaagcacatctcccaggacagggaatggtggattggactcacgtggaacttggcacggaatggaaccacggaggggccggggacttggttggacacctccaatgtgacctacagcaactggcatggagggcaggccgccgctgcccctgacacctgcggccacatcgggagaggcccttcctctgagtgggtgacctcggactgcgcccagaccttcgccttcatgtgcgagttccgggttggccagagcctggcctgcgagggactcaatgccaccgtgcactgtggcttggggcaggtcatccaggtccaggatgccgtctacgggcgccagaatccccatttctgcacccaggatgccgggcgtccttcagatctggagcagggatgcagctgggccaacgtcaaggaggaggtggcaggccagtgccaggagctacagtcatgccaggtggcagcagatgagacctactttggaaacctgtgtccgactcagggcagttacctgtgggtgcagtaccagtgccgggaagccctgcagctgatggtgtccagtgagagtttcatctttgacaatgtcaccatctccctgacgtggctcctctcaccctacataggaaacctgtcctgtataattagtacaggagacagccacacttttgatccctacaacccgccgagtgtgtccagcaatgtgacccaccagttcacatctcctggggaattcaccgtgtttgctgaatgcacaaccagtgagtggcatgtgacagctcagaggcaggtgaccgtgcgagacaagatggagacgctcagtgtgactgcatgctccggcctgtcccagtcaggagccggccctctctgccaggctgtctttggggatcctctgtggattcaggtggagcttgatggaggaacaggagtgacttacactgtgcttttgggtgacataaccctggccgagtccaccacccaaaagggctcgctaccgtacaatctgatcctggacagagaaacccagaaactgatgggccctgggaggcaccgcctggagatccaagccaccggcaacaccaccacctctacaatctccagaaacattacagtccacttggtggagctgctgtcagggctgcaggcctcctgggcttctgaccatttggagcttggacaggacctattgatcaccatctcattggctcagggcaccccggaagagctgacctttgaggtggctggactcaatgcaaccttctcccacgagcaagtgagctttggagagccatttgggatttgccgcctggctgttccggttgaaggcacctttctggtcaccatgctggtgaggaatgccttctccaacctgagtttggaaatcgggaacatcactatcacagccccttccggtctccaagaaccatctgggatgaatgctgaaggaaagagtaaagataaaggcgatatggaggtgtacatccaacctggtccatatgtggatcctttcacgacagtgaccctgggctggccagacaatgacaaggagttacgcttccaatggtcatgtgggtcttgctgggctctgtggagcagctgtgttgagaggcagctgcttcgcacagaccagagggagctggtggttccagcatcctgcctgccgccgcctgactctgctgtcaccctgcgcctggctgttctgagaggccaagagctggagaacagggcagagcagtgcctctacgtgtctgcgccctgggaactcaggcctcgagtcagctgtgagaggaactgcaggccagttaatgccagcaaagacattctgctcagggtcaccatgggggaggactctccagtggctatgttcagctggtatttggacaacaccccaacagagcaggctgagcccctcctggatgcctgcagactcagaggattttggccaaggtccttaaccctcctccagagcaacacctccacgttgctgttgaacagctcgtttctgcagtcccggggagaggtcatccgaatcagagccacagcactgaccaggcatgcctatggggaggacacctatgtgatcagcactgtgcctccccgtgaggtgcctgcctgcactattgccccagaggagggcaccgttctgacgagctttgccatcttctgcaacgcctccacagccctgggacccctggagttctgcttctgtctggaatcaggttcctgcctacactgtggccctgaacctgccctcccatcagtgtatctgccacttggagaggagaacaatgactttgtgctgacagtagttatttctgccaccaatcgtgcaggggacacgcagcagacccaggccatggctaaggtggcactcggagacacatgtgttgaggatgtagcattccaggctgccgtgtcagagaaaatccccacagctctgcaaggcgagggtggccccgagcagctcctccagctggccaaggctgtgtcctccatgctgaaccaagagcatgaaagccagggctcaggacagtcactgagcatagacgtcagacagaaggtcagagagcatgtgctgggatcactgtctgcagtcaccaccggcttggaggacgtgcagagggtgcaggagctggccgaggtgctgagagaggtgacctgccggagtaaggaactcacaccctcggcccagtgggaggccagcttggctctacagcatgccagtgaggccctgttgacagtgagtgccaaggcccgccctgaggaccagaggcgccaggcagccaccagggacctgtttcaggctgtgggcagtgtgctggaagcttccctgagcaacagaccagaagagcctgcggaggccagcagcagccagattgccacagtgctgcggctgcttcgagtcatggagcatgtgcagaccaccctcctgctgggaaaactgccagggggccttccagccatgctggccaccccctccatctctgtgtacacaaacagaatacaaccctggagttggcaaggctcctccctgcgccctgatgccgcagactctgcaaccttcatgctgcccgctgcctcctccctcagctctctggagggcggccaggagcccgtggatataaagatcatgagtttcccaaagagcccctttccagcccgaagccactttgatgtcagcgggactgtcggtggcctccgtgtgaccagccctagtggtcaactcatacctgtgaagaatctgtcggagaatatcgagatcctgctgccccggcattcacaaagacacagccagccgaccgtgttgaacctgaccagtcctgaagctttgtgggtgaacgtgacttcaggggaggcaaccttggggatccagctgcactggagaccagacattgcactcacgcttagcctgggctatggctaccaccccaacaagagcagctacgatgcccaaactcacctcgtaccaatggtggctccagatgagctgcccacgtggatcctgagcccacaggacctgcgttttggagaaggggtctactatttgactgtggtccctgagtctgacctggagccagcccccggcagggacctcacggttggcatcaccaccttcctgtctcactgtgtgttctgggatgaggtccaggagacttgggacgactcaggatgccaggtggggcctcggaccagcccctaccagacacactgcctctgcaaccacctcactttcttcggaagcacgttcctggtgatgtccaatgccatcaacatccaccagactgctgagctctttgccacctttgaggacaaccctgtggtcgtgaccaccgtgggctgcctgtgtgtggtctacgtgctggtggtgatctgggcgaggaggaaggacgctcaggatcaggccaaggtgaaggtcacagtgctggaagacaatgatccctttgctcagtaccactacctggtgacagtctacacaggacaccgacgaggggcagccacgtcctcaaaggtgactgtcaccctgtatggcctggatggagagagagagccccaccacctggctgatcccgacactccggtttttgagcgaggagcagtggatgccttcctcctctccaccctgttccccctgggagaactgcggagcctccggctgtggcatgacaactcaggggaccggccatcgtggtatgtgagccgggtgctggtctatgacctggtgatggaccggaagtggtatttcctgtgcaactcctggctatccatcaatgttggagattgcgtcctcgataaggtgtttcctgtggccacggagcaggacagaaaacaattcagccacctgtttttcatgaagacttccgcgggcttccaggatggacacatctggtattcgatcttcagccgctgcgctcgcagcagcttcacccgcgtccagagggtgtcctgctgcttctccctgctgctgtgcaccatgctgaccagcatcatgttctggggggtccccaaggacccagctgagcaaaagatggacttgggtaaaattgaattcacctggcaggaggtgatgattggcctggagagctccatcctcatgttccccatcaacctcctgattgttcagatctttcagaacacccgtccccgggtcgcgaaggagcagaacactggaaaatgggaccgggggtcccccaacctgactccctccccacagcccatggaggacggccttctgacacctgaggcagtgaccaaggatgtgtcaagaatcgtcagctccctcttcaaagctctcaaggtgccatcccccgccttgggctgggactcagtgaacttgatggacatcaacagtctcctcgccttggtggaagatgtcatttatccacagaacacatcagggcaggtgttctgggaggaagccaaaaagagagaggaccctgtaacactcactttggggtcatcagaaatgaaagagaaatcacagtgtcccaagcccaaggcggcacggagtggcccctggaaggacagcgcctacaggcagtgtctgtaccttcagctggaacacgtggagcaagagctgcggctggtggggccccgaggcttctcccagccccacagccatgcctaggccctcaggcagctgcagaccctgaagggcggcctgggggtacagccgggcacctgggcccctgcacatgccagcgctcttcaggtgagcaaaccccctcaaggcctgccctggtggtgcatcctggtgggctggctcctggtagcggccaccagtggcgtggcggccttcttcaccatgctctacggcctgcactacgggagggccagctccctcaggtggctcatctccatggctgtctccttcgtggagagcatgttcgtcacccagcccctgaaggtgctgggattcgctgctttctttgcactggtcttgaagagagtggacgatgaggaggatactgtggccccgctgccaggacatctgttgggcccagacccctatgccttgttccgagcacgaagaaacagcagcagggatgtctaccagccacctctcaccgctgccattgagaagatgaaaaccacccacctcaaggaacagaaagcatttgccctcatcagagaaatcctggcatacttgggcttcctgtggatgctactgctcgtggcctacgggcagagggaccccagcgcctaccacctcaacagacacctccagcacagcttcaccaggggcttttcaggtgtgctcggcttccgagagttcttcaagtgggccaacaccaccctcgtgagtaacctgtatggtcaccccccaggctttatcactgatgggaactccaagctggttggcagtgcccagattcgtcaagtgagggtccaggaaagctcttgccctcttgcccagcagccgcaggcatatctcaacggatgccgtgcaccatattccctggatgctgaagacatggcagactatggggaaggctggaatgccaccaccctcagtaatggcagtaccagagccaggaccaacgtcaagggtatcccatctggggcaaactcactgtgtaccggggaggaggctacgtggtccccttggggactgatcgccaaagcacgtcaagaattctccgctatctctttgacaacacctggctggacgccctgaccagagctgtgtttgtggagtccactgtctacaacgccaacgtcaacctgttctgcattgtcacgctgacgctagagaccagcgctctgggcaccttttttacgcacgcggccctgcagagcctccgcctgtaccccttcaccgacggctggcaccccttcgtggtagcggcagagctcatctacttcctcttcctcctctactacatggtggtgcagggcaagcgcatgagtaaagagacgtggggctatttctgcagcaagtggaaccttctggagctggccatcatcctggccagctggagcgccctggcggtgtttgtgaagagggctgtcctggccgaaagggacctccagcgctgccggaaccacagggaggaaggcatcagcttcagtgagacagcagcagccgatgccgcccttggctacatcattgccttcctggtactcctgtccacagtgaagctttggcatctgctcaggttgaatcccaaaatgaacatgatcacggcagccctacgccgtgcctggggcgacatttcaggctttatgattgtcatccttaccatgctcctggcttactccatcgcgtcaaacttgatatttggttggaaactccgttcctacaaaaccctctttgatgcggcggagacgatggtcagccttcagctgggaatcttcaactacgaggaggtcctggactatagcccagtgcttggctccttcctcattggatcctgcattgtttttatgacatttgtggtgctgaacctgtttatctctgtcatcctggtggccttcagtgaggagcaaaaatactatcagagacttgaccatccgaggatttt

SEQ ID NO: 5814 - DNA, 1493 bp, synthetic construct; identical to SEQ ID NO: 1536
  misc_feature 1..1493: note = Synthetic polypeptide
  source 1..1493: mol_type = other DNA

SEQ ID NO: 5815 - DNA, 1229 bp, synthetic construct
  misc_feature 1..1229: note = Synthetic polypeptide
  source 1..1229: mol_type = other DNA
atgggtgccaaggagtcacggatcggattcctcagctacgaggaggcgctgaggagagttacagatgtagagctaaaacgactgaaggatgctttcaagaggacctgtggactctcatattacatgggccagcactgcttcatccgggaagtgcttggggatggagtgcctccaaaggttgctgaggtgatttactgttcttttggtggaacatccaaagggctgcacttcaataatttaatagttggacttgtcctccttacaagaggcaaagatgaagagaaagcaaaatacatttttagtcttttttcaagtgaatctgggaactatgttatacgggaagaaatggaaagaatgctccacgtggtggatggtaaagtcccagatacactcaggaagtgtttctcagagggtgaaaaggtaaactatgaaaagtttagaaattggctttttctaaacaaagatgcttttactttctctcgatggcttctatctggaggtgtgtatgttaccctcactgatgatagtgatactcctactttctaccaaactctggctggagtcacacatttggaggaatcagacatcattgatcttgagaaacgctattggttattgaaggctcaatcccggactggacgatttgatttagagacatttggcccattggtttcaccacctattcgtccatctctaagtgaaggtttgtttaatgcttttgatgaaaatcgtgacaatcacatagattttaaggagatatcctgtgggttatcagcctgttgcaggggacccctggctgaaagacaaaaattttgcttcaaggtatttgatgttgaccgtgatggagttctctccagggttgaactgagagacatggtggttgcacttttagaagtctggaaggacaaccgcactgatgatattcctgaattacatatggatctctctgatattgtagaaggcatactgaatgcacatgacaccacaaagatgggtcatcttactctggaagactatcagatctggagtgtgaaaaatgttcttgccaatgagtttttgaacctccttttccaggtgtgtcacatagttctggggttaagaccagctactccggaagaagaaggacaaattattaggaaatctgtctttaaatactgaaggaagttcttcaagctgaaaataagtgacaccagacggttattaacatccacatgaacaaataaagaggc

SEQ ID NO: 5816 - DNA, 239 bp, synthetic construct
  misc_feature 1..239: note = Synthetic polypeptide
  source 1..239: mol_type = other DNA
atgggtcatcttactctggaagactatcagatctggagtgtgaaaaatgttcttgccaatgagtttttgaacctccttttccaggtgtgtcacatagttctggggttaagaccagctactccggaagaagaaggacaaattattaggaaatctgtctttaaatactgaaggaagttcttcaagctgaaaataagtgacaccagacggttattaacatccacatgaacaaataaagaggc

SEQ ID NO: 5817 - DNA, 1220 bp, synthetic construct
  misc_feature 1..1220: note = Synthetic polypeptide
  source 1..1220: mol_type = other DNA
atgcgttacgtgcggagatgcgtccccctccccggcgctcctgcgcgcgttacagatgtagagctaaaacgactgaaggatgctttcaagaggacctgtggactctcatattacatgggccagcactgcttcatccgggaagtgcttggggatggagtgcctccaaaggttgctgaggtgatttactgttcttttggtggaacatccaaagggctgcacttcaataatttaatagttggacttgtcctccttacaagaggcaaagatgaagagaaagcaaaatacatttttagtcttttttcaagtgaatctgggaactatgttatacgggaagaaatggaaagaatgctccacgtggtggatggtaaagtcccagatacactcaggaagtgtttctcagagggtgaaaaggtaaactatgaaaagtttagaaattggctttttctaaacaaagatgcttttactttctctcgatggcttctatctggaggtgtgtatgttaccctcactgatgatagtgatactcctactttctaccaaactctggctggagtcacacatttggaggaatcagacatcattgatcttgagaaacgctattggttattgaaggctcaatcccggactggacgatttgatttagagacatttggcccattggtttcaccacctattcgtccatctctaagtgaaggtttgtttaatgcttttgatgaaaatcgtgacaatcacatagattttaaggagatatcctgtgggttatcagcctgttgcaggggacccctggctgaaagacaaaaattttgcttcaaggtatttgatgttgaccgtgatggagttctctccagggttgaactgagagacatggtggttgcacttttagaagtctggaaggacaaccgcactgatgatattcctgaattacatatggatctctctgatattgtagaaggcatactgaatgcacatgacaccacaaagatgggtcatcttactctggaagactatcagatctggagtgtgaaaaatgttcttgccaatgagtttttgaacctccttttccaggtgtgtcacatagttctggggttaagaccagctactccggaagaagaaggacaaattattaggaaatctgtctttaaatactgaaggaagttcttcaagctgaaaataagtgacaccagacggttattaacatccacatgaacaaataaagaggc

SEQ ID NO: 5818 - DNA, 341 bp, synthetic construct
  misc_feature 1..341: note = Synthetic polypeptide
  source 1..341: mol_type = other DNA
atgggtgccaaggagtcacggatcggattcctcagctacgaggaggcgctgaggagagttacagatgtagagctaaaacgactgaaggatgctttcaagaggacctgtggactctcatattacatgggccagcactgcttcatccgggaagtgcttggggatggagtgcctccaaaggttgctgaggtgtgtcacatagttctggggttaagaccagctactccggaagaagaaggacaaattattaggaaatctgtctttaaatactgaaggaagttcttcaagctgaaaataagtgacaccagacggttattaacatccacatgaacaaataaagaggc

SEQ ID NO: 5819 - DNA, 611 bp, synthetic construct
  misc_feature 1..611: note = Synthetic polypeptide
  source 1..611: mol_type = other DNA
atgaagcacctgaagcggtggtggtcggccggcggcggcctcctgcacctcaccctcctgctgagcttggcggggctccgcgtagacctagatctttacctgctgctgccgccgcccaccctgctgcaggacgagctgctgttcctgggcggcccggccagctccgcctacgcgctcagccccttctcggcctcgggagggtgggggcgcgcgggccacttgcaccccaagggccgggagctggaccctgccgcgccgcccgagggccagctgctccgggaggtgcgcgcgctcggggtccccttcgtccctcgcaccagcgtggatgcatggctggtgcacagcgtggctgccgggagcgcggacgaggcccacgggctgctcggcgccgccgccgcctcgtccaccggaggagccggcgccagcgtggacggcggcagccaggctgtgcaggggggcggcggggacccccgagcggctcggagtggccccttggacgccggggaagaggagaaggcacccgcggaaccgacggctcaggtgccggacgctggcggatgtgcgagcgaggataacagtgataccaaggcctaaaaaagcacatcagagaa

SEQ ID NO: 5820 - DNA, 1255 bp, synthetic construct
  misc_feature 1..1255: note = Synthetic polypeptide
  source 1..1255: mol_type = other DNA
atgaagcctcacttcagaaacacagtggagcgaatgtatcgagacacattctcctacaacttttataatagacccatcctttctcgtcggaataccgtctggctgtgctacgaagtgaaaacaaagggtccctcaaggccccgtttggacgcaaagatctttcgaggccaggtgtattcccagcctgagcaccacgcagaaatgtgcttcctctcttggttctgtggcaaccagctgcctgcttacaagtgtttccagatcacctggtttgtatcctggaccccctgcccggactgtgtggcgaagctggccgaattcctggctgagcaccccaatgtcaccctgaccatctccgccgcccgcctctactactactgggaaagagattaccgaagggcgctctgcaggctgagtcaggcaggggcccgcgtgaagattatggacgatgaagaatttgcatactgctgggaaaactttgtgtacagtgaaggtcagccattcatgccttggtacaaattcgatgacaattatgcattcctgcaccgcacgctaaaggagattctcagaaacccgatggaggcaatgtatccacacatattctacttccactttaaaaacctacgcaaagcctatggtcggaacgaaagctggctgtgcttcaccatggaagttgtaaagcaccactcacctgtctcctggaagaggggcgtcttccgaaaccaggtggatcctgagacccattgtcatgcagaaaggtgcttcctctcttggttctgtgacgacatactgtctcctaacacaaactacgaggtcacctggtacacatcttggagcccttgcccagagtgtgcaggggaggtggccgagttcctggccaggcacagcaacgtgaatctcaccatcttcaccgcccgcctctactacttctgggatacagattaccaggaggggctccgcagcctgagtcaggaaggggcctccgtggagatcatgggctacaaagctaaaacagagcccaggagccagggaggaaaagcagtcaggccacacaccattgctcccaaaatggacttctctgcaagcctgactcctgaaactgtgcattgtaccctgaaaccagctttatccatagcttctgcaataaatggctgtaagtcttggactccttgctataatcgcagctattcagcaatggaacctcccagttcccaacccttcctagtgcccatgggctttcccataggacaagagaaca

SEQ ID NO: 5821 - DNA, 1206 bp, synthetic construct; identical to SEQ ID NO: 282
  misc_feature 1..1206: note = Synthetic polypeptide
  source 1..1206: mol_type = other DNA

SEQ ID NO: 5822 - DNA, 1209 bp, synthetic construct; identical to SEQ ID NO: 281
  misc_feature 1..1209: note = Synthetic polypeptide
  source 1..1209: mol_type = other DNA

SEQ ID NO: 5823 - DNA, 1203 bp, synthetic construct; identical to SEQ ID NO: 286
  misc_feature 1..1203: note = Synthetic polypeptide
  source 1..1203: mol_type = other DNA

SEQ ID NO: 5824 - DNA, 215 bp, synthetic construct
  misc_feature 1..215: note = Synthetic polypeptide
  source 1..215: mol_type = other DNA
atggaccgcacttgtgaggagaggcccgctgaggatgggagcgacgaggaggacccagactccatggaagccccaacccggatccgggacactccggaagacatcgtgctggaagctccggctagtgggctggcgttccatccggcccgtgacctactggctgcaggggacgtggacggggacgtgttcggggaattatacctacccttgcagag

SEQ ID NO: 5825 - DNA, 1411 bp, synthetic construct
  misc_feature 1..1411: note = Synthetic polypeptide
  source 1..1411: mol_type = other DNA
atgcgcctgactcacatctgctgctgctgcctcctttaccagctggggttcctgtcgaatgggatcgtttcagagctgcagttcgcccccgaccgcgaggagtgggaagtcgtgtttcctgcgctctggcgccgggagccggtggacccggctggcggcagcgggggcagcgcggacccgggctgggtgcgcggcgttgggggcggcggaagcgcccgggcgcaggctgccggcagctcacgcgaggtgcgctctgtggctccggtgcctttggaggagcccgtggagggccgatcagagtcccggctccggcccccgccgccgtcggagggtgaggaggacgaggagctcgagtcgcaggagctgccgcggggatccagcggggctgccgccttgtccccgggcgccccggcctcgtggcagccgccgcctcccccgcagccgcccccgtccccgcccccggcccagcatgccgagccggatggcgacgaagtgttgctgcggatcccggccttctctcgggacctgtacctgctgctccggagagacggccgcttcctggcgccgcgcttcgcagtggaacagcggccaaatcccggccccggccccacgggggcagcatccgccccgcaacctcccgcgccaccagacgcaggctgcttctacaccggagctgtgctgcggcaccctggctcgctggcttctttcagcacctgtggaggtggcctgatgggatttatacagctcaatgaggacttcatatttattgagccactcaatgatacaatggccataacaggtcacccacaccgtgtatataggcagaaaaggtccatggaggaaaaggtcacagagaagtcagctcttcacagtcattactgtggtatcatttcagataaaggaagacctaggtctagaaaaatagcagaaagtggaagagggaaacgatattcatacaaattacctcaagaatacaacatagagactgtagtggttgcagacccagcaatggtttcctatcatggagcagatgcagccaggagattcattctaaccatcttaaatatggtatttaaccttttccaacacaagagtctgagtgtgcaggtcaatcttcgtgtgataaagcttattctgctccatgaaactccaccagaactatatattgggcatcatggagaaaaaatgctagagagtttttgtaagtggcaacatgaagaatttggcaaaaagaatgatatacatttagagatgtcaacaaactggggggaagacatgacttcagtggatgcagctatacttataacaaggtgaatggatgtattgtgtgatcatacaattgaatactcttcatcaaactgctaataaatgcaaccacatggatggatgaatatgaatatcattatactga

SEQ ID NO: 5826 - DNA, 5394 bp, synthetic construct; identical to SEQ ID NO: 3213
  misc_feature 1..5394: note = Synthetic polypeptide
  source 1..5394: mol_type = other DNA

SEQ ID NO: 5827 - DNA, 5259 bp, synthetic construct; identical to SEQ ID NO: 3214
  misc_feature 1..5259: note = Synthetic polypeptide
  source 1..5259: mol_type = other DNA

SEQ ID NO: 5828 - DNA, 5409 bp, synthetic construct; identical to SEQ ID NO: 3215
  misc_feature 1..5409: note = Synthetic polypeptide
  source 1..5409: mol_type = other DNA

SEQ ID NO: 5829 - DNA, 5403 bp, synthetic construct; identical to SEQ ID NO: 3216
  misc_feature 1..5403: note = Synthetic polypeptide
  source 1..5403: mol_type = other DNA

SEQ ID NO: 5830 - DNA, 272 bp, synthetic construct; identical to SEQ ID NO: 3217
  misc_feature 1..272: note = Synthetic polypeptide
  source 1..272: mol_type = other DNA

SEQ ID NO: 5831 - DNA, 657 bp, synthetic construct; identical to SEQ ID NO: 180
  misc_feature 1..657: note = Synthetic polypeptide
  source 1..657: mol_type = other DNA

SEQ ID NO: 5832 - DNA, 423 bp, synthetic construct; identical to SEQ ID NO: 179
  misc_feature 1..423: note = Synthetic polypeptide
  source 1..423: mol_type = other DNA

SEQ ID NO: 5833 - DNA, 568 bp, synthetic construct; identical to SEQ ID NO: 1967
  misc_feature 1..568: note = Synthetic polypeptide
  source 1..568: mol_type = other DNA

SEQ ID NO: 5834 - DNA, 379 bp, synthetic construct; identical to SEQ ID NO: 1968
  misc_feature 1..379: note = Synthetic polypeptide
  source 1..379: mol_type = other DNA

SEQ ID NO: 5835 - DNA, 4277 bp, synthetic construct; identical to SEQ ID NO: 2069
  misc_feature 1..4277: note = Synthetic polypeptide
  source 1..4277: mol_type = other DNA

SEQ ID NO: 5836 - DNA, 451 bp, synthetic construct; identical to SEQ ID NO: 339
  misc_feature 1..451: note = Synthetic polypeptide
  source 1..451: mol_type = other DNA

SEQ ID NO: 5837 - DNA, 2230 bp, synthetic construct
  misc_feature 1..2230: note = Synthetic polypeptide
  source 1..2230: mol_type = other DNA
atgaaagtgattgtaatccataggaaaatgtttcaacgtgcgcaagagttgcggcggcgggcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctgctcactccccttccaccctcagcggatgataatctcaagacacctcccgagtgtctgctcactccccttccaccctcagctccaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccttccaccctcagcggatgataatctcaagacaccttccgagcgtcagctcactccccttccaccctcagctccactctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttctgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacatggaaccac

SEQ ID NO: 5838 - DNA, 715 bp, synthetic construct; identical to SEQ ID NO: 1181
  misc_feature 1..715: note = Synthetic polypeptide
  source 1..715: mol_type = other DNA

SEQ ID NO: 5839 - DNA, 589 bp, synthetic construct; identical to SEQ ID NO: 1182
  misc_feature 1..589: note = Synthetic polypeptide
  source 1..589: mol_type = other DNA

SEQ ID NO: 5840 - DNA, 352 bp, synthetic construct; identical to SEQ ID NO: 1183
  misc_feature 1..352: note = Synthetic polypeptide
  source 1..352: mol_type = other DNA

SEQ ID NO: 5841 - DNA, 180 bp, synthetic construct; identical to SEQ ID NO: 1184
  misc_feature 1..180: note = Synthetic polypeptide
  source 1..180: mol_type = other DNA

SEQ ID NO: 5842 - DNA, 226 bp, synthetic construct; identical to SEQ ID NO: 1185
  misc_feature 1..226: note = Synthetic polypeptide
  source 1..226: mol_type = other DNA

SEQ ID NO: 5843 - DNA, 280 bp, synthetic construct; identical to SEQ ID NO: 1186
  misc_feature 1..280: note = Synthetic polypeptide
  source 1..280: mol_type = other DNA

SEQ ID NO: 5844 - DNA, 2739 bp, synthetic construct
  misc_feature 1..2739: note = Synthetic polypeptide
  source 1..2739: mol_type = other DNA
atgtcttcatcacattttgccagtcgacacaggaaggatataagtactgaaatgattagaactaaaattgctcataggaaatcactgtctcagaaagaaaatagacataaggaatacgaacgaaatagacactttggtttgaaagatgtaaacattccaaccttggaaggtagaattcttgttgaattagatgagacatctcaagggcttgttccagaaaagaccaatgttaagccaagggcaatgaaaactattctaggtgatcaacgaaaacagatgctccaaaaatacaaagaagaaaagcaacttcaaaaattgaaagagcagagagagaaagctaaacgaggaatatttaaagtgggtcgttatagacctgatatgccttgttttcttttatcaaaccagaatgctgtgaaagctgagccaaaaaaggctattccatcttctgtacggattacaaggtcaaaggccaaagaccaaatggagcagactaagattgataacgagagtgatgttcgagcaatccgacctggtccaagacaaacttctgaaaagaaagtgtcagacaaagagaaaaaagttgtgcagcctgtaatgcccacgtcgttgagaatgactcgatcagctactcaagcagcaaagcaggttcccagaacagtctcatctaccacagcaagaaagccagtcacaagagctgctaatgaaaacgaaccagaaggaaaggtgccaagtaaaggaagacctgccaaaaatgtagaaacaaaacccgacaagggtatttcttgtaaagtcgatagtgaagaaaatactttgaattcacaaactaatgcaacaagtggaatgaatccagatggagtcttatcaaaaatggaaaacttacctgagataaatactgcaaaaataaaagggaagaattcctttgcacctaaggattttatgtttcagccactggatggtctgaagacctatcaagtaacacctatgactcccagaagtgccaatgcttttttgacacccagttacacctggactcctttaaaaacagaagttgatgagtctcaagcaacaaaagaaattttggcacaaaaatgtaaaacttactctaccaagacaatacagcaagattcaaataaattgccatgtcctttgggtcctctaactgtttggcatgaagaacatgttttaaataaaaatgaagctactactaaaaatttaaatggccttccaataaaagaagtcccatcacttgaaagaaatgaaggtcgaattgctcagccccaccatggtgtgccatatttcagaaatatcctccagtcagaaactgagaaattaacttcacattgcttcgagtgggacaggaaacttgaattggacattccagatgatgctaaagatcttattcgcacagcagttggtcaaacaagactccttatgaaggaaaggtttaaacagtttgaaggactggttgatgattgtgaatataaacgaggtataaaggagactacctgtacagatctggatggattttgggatatggttagttttcagatagaagatgtaatccacaaattcaacaatctgatcaaacttgaggaatctgggtggcaagtcaataataatatgaatcataatatgaacaaaaatgtctttaggaaaaaagttgtctcaggtatagcaagtaaaccaaaacaggatgatgctggaagaattgcagcgagaaatcgcctagctgccataaaaaatgcaatgagagagagaattaggcaggaagaatgtgctgaaacagcagtttctgtgataccaaaggaagttgataaaatagtgttcgatgctggatttttcagagttgaaagtcctgttaaattattctcaggactttctgtctcttctgaaggcccttctcaaagacttggaacacctaagtctgtcaacaaagctgtatctcagagtagaaatgagatgggcattccacaacaaactacatcaccagaaaatgccggtcctcagaatacgaaaagtgaacatgtgaagaagactttgtttttgagtattcctgaaagcaggagcagcatagaagatgctcagtgtcctggattaccagatttaattgaagaaaatcatgttgtaaataagacagacttgaaggtggattgtttatccagtgagagaatgagtttgcctcttcttgctggtggagtagcagatgatattaatactaacaaaaaagaaggaatttcagatgttgtggaaggaatggaactgaattcttcaattacatcacaggatgttttgatgagtagccctgaaaaaaatacagcttcacaaaatagcatcttagaagaaggggaaactaaaatttctcagtcagaactatttgataataaaagtctcactactgaatgccaccttcttgattcaccaggtctaaactgcagtaatccatttactcagctggagaggagacatcaagaacatgccagacacatttcttttggtggtgtcctatagtcagtgactgatcaaagtgggggtataaaaaggcctggccccgcttgaagctctgaagaagaatcccagcttcagaactccccctagggtagggtaagttattgctgctcaacttctccctcaactcaatcatgtctttcccatccccacatgtattgattgcaagtacactccctcacaagcttcttgagatctaatctctctgcttcctgggagacccaacctgtgaca

SEQ ID NO: 5845 - DNA, 415 bp, synthetic construct; identical to SEQ ID NO: 4339
  misc_feature 1..415: note = Synthetic polypeptide
  source 1..415: mol_type = other DNA

SEQ ID NO: 5846 - DNA, 1266 bp, synthetic construct
  misc_feature 1..1266: note = Synthetic polypeptide
  source 1..1266: mol_type = other DNA
atgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctgtcttctctgtgagttgctcagcagcagctttattacctgtatggttacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctgttttcaacaacaacaaaagatgtgaagaaacagcaattacagccgcctatatatgggggaaaaaacttagaaaacagaaaccatccctgagaaaacccagacattagatctattaaacaaaaagtttgtcaacctttaaatatgctttaaaaactaaagtaaaccgtggacaaagaacaggagaaaggaaaataatgtataaacaaagtgaaagtatcagtaaatagaaaacatgaaaaattctggagctgaaaaatttcttagaggggtttacagatttaaacaggcagaagaatcagcaaatttgaaaataggacaaatgtaattatccagtccgaggaacagaaagaaaaaagaatgaagagtgaacagagcttgagggatctgtggcattttatcaagttaccaacatacgcattaaaggagttccagaaaatgaaaagaaaaaggcagaaataatatttgaggaaataatggctgagacttcccaaattcaatgaaatacatgagctacacattcaagaagatcaacaaattataactaggataaactcagagatctattactaaacacattacaatcaagctgtcaaaagccagagacaaagacagtcgttaaagcagcaggagaaaaacaacttatcacatacaagggatcctgtgtaagattaaatgcctaccactcatcagaaactacagaggtcagaaggctgtagaatgacatattcaaagtgctaaaagaaaaaaacttaacagagaattttagatccagcaaaactatccttcaaaactataagaaaggat

SEQ ID NO: 5847 - DNA, 1008 bp, synthetic construct
  misc_feature 1..1008: note = Synthetic polypeptide
  source 1..1008: mol_type = other DNA
atggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctgttttcaacaacaacaaaagatgtgaagaaacagcaattacagccgcctatatatgggggaaaaaacttagaaaacagaaaccatccctgagaaaacccagacattagatctattaaacaaaaagtttgtcaacctttaaatatgctttaaaaactaaagtaaaccgtggacaaagaacaggagaaaggaaaataatgtataaacaaagtgaaagtatcagtaaatagaaaacatgaaaaattctggagctgaaaaatttcttagaggggtttacagatttaaacaggcagaagaatcagcaaatttgaaaataggacaaatgtaattatccagtccgaggaacagaaagaaaaaagaatgaagagtgaacagagcttgagggatctgtggcattttatcaagttaccaacatacgcattaaaggagttccagaaaatgaaaagaaaaaggcagaaataatatttgaggaaataatggctgagacttcccaaattcaatgaaatacatgagctacacattcaagaagatcaacaaattataactaggataaactcagagatctattactaaacacattacaatcaagctgtcaaaagccagagacaaagacagtcgttaaagcagcaggagaaaaacaacttatcacatacaagggatcctgtgtaagattaaatgcctaccactcatcagaaactacagaggtcagaaggctgtagaatgacatattcaaagtgctaaaagaaaaaaacttaacagagaattttagatccagcaaaactatccttcaaaactataagaaaggat

SEQ ID NO: 5848 - DNA, 936 bp, synthetic construct
  misc_feature 1..936: note = Synthetic polypeptide
  source 1..936: mol_type = other DNA
gagtcctctcaagagaataaaactgtgtcagaggctgaatcaagaatcttttggttgggacttattgcctgttcagtactgtgggtgatatttgcctttagtgcactcttctccttcacagtaaagtggctgttttcaacaacaacaaaagatgtgaagaaacagcaattacagccgcctatatatgggggaaaaaacttagaaaacagaaaccatccctgagaaaacccagacattagatctattaaacaaaaagtttgtcaacctttaaatatgctttaaaaactaaagtaaaccgtggacaaagaacaggagaaaggaaaataatgtataaacaaagtgaaagtatcagtaaatagaaaacatgaaaaattctggagctgaaaaatttcttagaggggtttacagatttaaacaggcagaagaatcagcaaatttgaaaataggacaaatgtaattatccagtccgaggaacagaaagaaaaaagaatgaagagtgaacagagcttgagggatctgtggcattttatcaagttaccaacatacgcattaaaggagttccagaaaatgaaaagaaaaaggcagaaataatatttgaggaaataatggctgagacttcccaaattcaatgaaatacatgagctacacattcaagaagatcaacaaattataactaggataaactcagagatctattactaaacacattacaatcaagctgtcaaaagccagagacaaagacagtcgttaaagcagcaggagaaaaacaacttatcacatacaagggatcctgtgtaagattaaatgcctaccactcatcagaaactacagaggtcagaaggctgtagaatgacatattcaaagtgctaaaagaaaaaaacttaacagagaattttagatccagcaaaactatccttcaaaactataagaaaggat

SEQ ID NO: 5849 - DNA, 1074 bp, synthetic construct
  misc_feature 1..1074: note = Synthetic polypeptide
  source 1..1074: mol_type = other DNA
atggttacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctgttttcaacaacaacaaaagatgtgaagaaacagcaattacagccgcctatatatgggggaaaaaacttagaaaacagaaaccatccctgagaaaacccagacattagatctattaaacaaaaagtttgtcaacctttaaatatgctttaaaaactaaagtaaaccgtggacaaagaacaggagaaaggaaaataatgtataaacaaagtgaaagtatcagtaaatagaaaacatgaaaaattctggagctgaaaaatttcttagaggggtttacagatttaaacaggcagaagaatcagcaaatttgaaaataggacaaatgtaattatccagtccgaggaacagaaagaaaaaagaatgaagagtgaacagagcttgagggatctgtggcattttatcaagttaccaacatacgcattaaaggagttccagaaaatgaaaagaaaaaggcagaaataatatttgaggaaataatggctgagacttcccaaattcaatgaaatacatgagctacacattcaagaagatcaacaaattataactaggataaactcagagatctattactaaacacattacaatcaagctgtcaaaagccagagacaaagacagtcgttaaagcagcaggagaaaaacaacttatcacatacaagggatcctgtgtaagattaaatgcctaccactcatcagaaactacagaggtcagaaggctgtagaatgacatattcaaagtgctaaaagaaaaaaacttaacagagaattttagatccagcaaaactatccttcaaaactataagaaaggat

SEQ ID NO: 5850 - DNA, 410 bp, synthetic construct
  misc_feature 1..410: note = Synthetic polypeptide
  source 1..410: mol_type = other DNA
atgtgcggcaataacatgtcaaccccgctgcccgccatcgtgcccgccgcccggaaggccaccgctgcggtgattttcctgcatggattgggagatactggatgcggtggctcatgcctgtaatctcagcactttgggaggtggaggcgggcggatcacctgaggtcaggagttcaggaccagcctggccaacatggcgaaaccccatctctactaaaaatacaaaaattagccaggtgtggtggcacatgcctgtaatcgcagctacttgggaggctgaggcaggagaatcacttgaacctgggaggcggagattgcagtgagccaagatcgcaccattgcactccagcctgggcaacaagagcagaagagcagaactctgtctcaaaaaaaaaaaaaacgaaaagaaa

SEQ ID NO: 5851 - DNA, 690 bp, synthetic construct
  misc_feature 1..690: note = Synthetic polypeptide
  source 1..690: mol_type = other DNA
atgggctgggggagccgctgctgctgcccgggacgtttggacctgctgtgcgtgctggcgctgctcgggggctgcctgctccccgtgtgtcggacgcgcgtctacaccaaccactgggcagtcaaaatcgccgggggcttcccggaggccaaccgtatcgccagcaagtacggattcatcaacataggacagataggggccctgaaggactactaccacttctaccatagcaggacgattaaaaggtcagttatctcgagcagagggacccacagtttcatttcaatggaaccaaagaaactctacaagccagaagagagtggggaccaatattcaacattcttaaagaaaagaattttcaaccaagaatttcatatccagccaaactaagcttcataagtgaaggagaaataaaatactttacagacaagcaaatgctgggagattttgtcaccaccaggcctgccctaaatgagctcctgaaggaagcactaaacatggaaaggaacaacaggtaccagccactgcaaaaacatgacaaattgtaaagaccatcaaggctaggaagaaactgcatcaactaacgagcaaaatcaccagctaacatcataatgacaggatcaaattcacacataacaatattaactttaaatgtaaatgtgctaaatgctccaattaaaagacacaaac

SEQ ID NO: 5852 - DNA, 1479 bp, synthetic construct
  misc_feature 1..1479: note = Synthetic polypeptide
  source 1..1479: mol_type = other DNA
atggagcagcgccgcgtcaccgacttcttcgcgcgccgccgccccgggcccccccgcatcgcgccgcccaagctggcctgccgcacccccagccccgccaggcccgcactccgcgccccggcctccgctaccagtggcagccgcaagcgcgcccgcccgcccgccgcccccggacgcgaccaggccaggccaccggcccgcaggagactgcggctgtcggtggacgaggtttccagccccagtacccccgaggccccagacatcccagcctgcccttctccgggccagaagataaagaaatccaccccggcagcaggtcagccgccccacctgacatccgcgcaggaccaggacaccatctctgagcttgcgtcatgcctgcaacgggcccgggagctgggggcaagagtccgggcgctgaaggccagtgcccaggatgctggggagtcctgcaccccagaggccgagggccgccctgaggagccatgtggcgagaaggcgcccgcctaccagcgcttccatgccctggcccagcccggcctgccgggactcgtgctgccctacaagtaccaggtgctggcggagatgttccgcagcatggacaccatcgtgggcatgctccacaaccgctccgagacgcccacctttgccaaggtccagcggggcgtccaggacatgatgcgtaggcgttttgaggagtgcaatgttggccagatcaaaaccgtgtacccggcctcctaccgcttccgccaggagcgcagtgtccccaccttcaaggatggcaccaggaggtcagattaccagctcaccatcgagccactgctggagcaggaggctgacggagcagccccccagctcacggcctcgcgcctcctgcagcgacggcagatcttcagccagaagctggtggagcatgtcaaggagcaccacaaggccttcctggcctccctgagccccgccatggtggtgccggaggaccagctgacccgctggcacccgcgcttcaacgtggatgaagtacccgacatcgagccggccgcgctgccccagccacccgccacggagaagctcaccactgctcaggaggtgctggcccgggcccgcaacctgatttcacccaggatggagaaggccttgagtcaattggccctgcgctctgctgcgcccagcagccccgggtctcccaggccagcactgccggctaccccaccagccaccccgcctgcagcctctcccagtgctctgaagggggtgtcccaggatctgctggagcggatccgagccaaggaggcacagaagcagctggcacagatgacgcggtgcccggagcaggagcagcggctgcagcgcttagaacggctgcctgagctggcccgcgtgctgcggagcgtctttgtgtccgaacgcaagcctgcgctcagcatggaggtggcctgtgccaggatggtgggcagctgttgtactatcatgagccctggg

SEQ ID NO: 5853 - DNA, 506 bp, synthetic construct; identical to SEQ ID NO: 1096
  misc_feature 1..506: note = Synthetic polypeptide
  source 1..506: mol_type = other DNA

SEQ ID NO: 5854 - DNA, 495 bp, synthetic construct
  misc_feature 1..495: note = Synthetic polypeptide
  source 1..495: mol_type = other DNA
atggacgatcaatccaggatgctgcagactctggccggggtgaacctggctggccactcggtgcaggggggcatggccctgccgcctcccccgcacggccacgaaggggcggacggcgacggcaggaagcaggacatcggcgacatcctccaccagatcatgaccatcaccgaccagagcttggacgaggcgcaagcaaagaaacatgccctgaactgtcacagaatgaaaccagcgctcttcagcgtcctgtgtgagatcaaagagaaaacagccagagctcaggcatatgacacagagccagccaatcagatgcagtcacctgagtttggaagaaagaagtgtgaagaaggtggtgctgtgtggaatctgtcctgatgaaggtggaagaactggcagagagataggcttttgggggtggcaaatggtagaaatcttaactatagcattctctgctcccaagatgcgaggtgtggtatctgtgcccagtggtag

SEQ ID NO: 5855 - DNA, 270 bp, synthetic construct
  misc_feature 1..270: note = Synthetic polypeptide
  source 1..270: mol_type = other DNA
atgaaaccagcgctcttcagcgtcctgtgtgagatcaaagagaaaacagccagagctcaggcatatgacacagagccagccaatcagatgcagtcacctgagtttggaagaaagaagtgtgaagaaggtggtgctgtgtggaatctgtcctgatgaaggtggaagaactggcagagagataggcttttgggggtggcaaatggtagaaatcttaactatagcattctctgctcccaagatgcgaggtgtggtatctgtgcccagtggtag

SEQ ID NO: 5856 - DNA, 1692 bp, synthetic construct; identical to SEQ ID NO: 1048
  misc_feature 1..1692: note = Synthetic polypeptide
  source 1..1692: mol_type = other DNA

SEQ ID NO: 5857 - DNA, 1695 bp, synthetic construct; identical to SEQ ID NO: 1049
  misc_feature 1..1695: note = Synthetic polypeptide
  source 1..1695: mol_type = other DNA

SEQ ID NO: 5858 - DNA, 466 bp, synthetic construct; identical to SEQ ID NO: 1050
  misc_feature 1..466: note = Synthetic polypeptide
  source 1..466: mol_type = other DNA

SEQ ID NO: 5859 - DNA, 1868 bp, synthetic construct
  misc_feature 1..1868: note = Synthetic polypeptide
  source 1..1868: mol_type = other DNA
atggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaagcaggcccttctgaaactgatgatgttgatgaaaaacagcccctatcgaagcctttgcaaggaagccaccattcttcagagggcaatgaaggcacagaaatggaagtaccagcagaagattctactcaacatgtcccttcagaaacaagtgaggaccctgaagttgaggtgactattgaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgatttgttgacagcggtttcctggagtgctgtcttgagaacgattctgaggaggctcagcaagaaagagtgtttcagttgattgggtgtgtctgtcatggagaaggaagtaaggagtgg

SEQ ID NO: 5860 - DNA, 1805 bp, synthetic construct
  misc_feature 1..1805: note = Synthetic polypeptide
  source 1..1805: mol_type = other DNA
atggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaagcaggcccttctgaaactgatgatgttgatgaaaaacagcccctatcgaagcctttgcaaggaagccaccattcttcagagggcaatgaaggcacagaaatggaagtaccagcagaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgatttgttgacagcggtttcctggagtgctgtcttgagaacgattctgaggaggctcagcaagaaagagtgtttcagttgattgggtgtgtctgtcatggagaaggaagtaaggagtgg

SEQ ID NO: 5861 - DNA, 1808 bp, synthetic construct
  misc_feature 1..1808: note = Synthetic polypeptide
  source 1..1808: mol_type = other DNA
atggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatggaagtaccagcagaagattctactcaacatgtcccttcagaaacaagtgaggaccctgaagttgaggtgactattgaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgatttgttgacagcggtttcctggagtgctgtcttgagaacgattctgaggaggctcagcaagaaagagtgtttcagttgattgggtgtgtctgtcatggagaaggaagtaaggagtgg

SEQ ID NO: 5862 - DNA, 1745 bp, synthetic construct
  misc_feature 1..1745: note = Synthetic polypeptide
  source 1..1745: mol_type = other DNA
atggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatggaagtaccagcagaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgatttgttgacagcggtttcctggagtgctgtcttgagaacgattctgaggaggctcagcaagaaagagtgtttcagttgattgggtgtgtctgtcatggagaaggaagtaaggagtgg

SEQ ID NO: 5863 - DNA, 266 bp, synthetic construct; identical to SEQ ID NO: 2578
  misc_feature 1..266: note = Synthetic polypeptide
  source 1..266: mol_type = other DNA

SEQ ID NO: 5864 - DNA, 944 bp, synthetic construct
  misc_feature 1..944: note = Synthetic polypeptide
  source 1..944: mol_type = other DNA
atggccgctgccgcggctgtggaggcggcggcgcctatgggtgccctatggggcctcgtgcacgacttcgtcgtgggtcagcaagagggccccgctgaccaggtggctgcagatgtgaaatctggcaactatacagtgttacaagttgtggaagcccttgggtcctctctagagaatccagaaccccgaactcgggcacgagcaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagagggccaagatataatgcctgg

SEQ ID NO: 5865 - DNA, 815 bp, synthetic construct
  misc_feature 1..815: note = Synthetic polypeptide
  source 1..815: mol_type = other DNA
atggccgctgccgcggctgtggaggcggcggcgcctatgggtgccctatggggcctcgtgcacgacttcgtcgtgggtcagcaagagggccccgctgaccaggtggctgcagatgtgaaatctggcaactatacagtgttacaagttgtggaagcccttgggtcctctctagagaatccagaaccccgaactcgggcacgagcaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaaggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagagggccaagatataatgcctgg

SEQ ID NO: 5866 - DNA, 110 bp, synthetic construct
  misc_feature 1..110: note = Synthetic polypeptide
  source 1..110: mol_type = other DNA
ctacagactctgaatgcttgctgtgctgtgtatggacagaaggaactgaaggacttcctccccagcctttgggcttctatccgcagagagggccaagatataatgcctgg

SEQ ID NO: 5867 - DNA, 917 bp, synthetic construct
  misc_feature 1..917: note = Synthetic polypeptide
  source 1..917: mol_type = other DNA
atggccgctgccgcggctgtggaggcggcggcgcctatgggtgccctatggggcctcgtgcacgacttcgtcgtgggtcagcaagagggccccgctgaccaggtggctgcagatgtgaaatctggcaactatacagtgttacaagttgtggaagcccttgggtcctctctagagaatccagaaccccgaactcgggcacgagcaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagagggccaagatataatgcctgg

SEQ ID NO: 5868 - DNA, 1310 bp, synthetic construct; identical to SEQ ID NO: 1882
  misc_feature 1..1310: note = Synthetic polypeptide
  source 1..1310: mol_type = other DNA

SEQ ID NO: 5869 - DNA, 395 bp, synthetic construct; identical to SEQ ID NO: 1883
  misc_feature 1..395: note = Synthetic polypeptide
  source 1..395: mol_type = other DNA

SEQ ID NO: 5870 - DNA, 371 bp, synthetic construct; identical to SEQ ID NO: 1884
  misc_feature 1..371: note = Synthetic polypeptide
  source 1..371: mol_type = other DNA

SEQ ID NO: 5871 - DNA, 1928 bp, synthetic construct; identical to SEQ ID NO: 2598
  misc_feature 1..1928: note = Synthetic polypeptide
  source 1..1928: mol_type = other DNA

SEQ ID NO: 5872 - DNA, 1034 bp, synthetic construct; identical to SEQ ID NO: 1229
  misc_feature 1..1034: note = Synthetic polypeptide
  source 1..1034: mol_type = other DNA

SEQ ID NO: 5873 - DNA, 616 bp, synthetic construct; identical to SEQ ID NO: 1230
  misc_feature 1..616: note = Synthetic polypeptide
  source 1..616: mol_type = other DNA

SEQ ID NO: 5874 - DNA, 1158 bp, synthetic construct
  misc_feature 1..1158: note = Synthetic polypeptide
  source 1..1158: mol_type = other DNA
atgaatatccaagagcagggtttccccttggacctcggagcaagtttcaccgaagatgctccccgacccccagtgcctggtgaggagggagaactggtgtccacagacccgaggcccgccagctacagtttctgctccgggaaaggtgttggcattaaaggtgagacttcgacggccactccgaggcgctcggatctggacctggggtatgagcctgagggcagtgcctcccccaccccaccatacttgaagtgggctgagtcactgcattccctgctggatgaccaagatgggataagcctgttcaggactttcctgaagcaggagggctgtgccgacttgctggacttctggtttgcctgcactggcttcaggaagctggagccctgtgactcgaacgaggagaagaggctgaagctggcgagagccatctaccgaaagtacattcttgataacaatggcatcgtgtcccggcagaccaagccagccaccaagagcttcataaagggctgcatcatgaagcagctgatcgatcctgccatgtttgaccaggcccagaccgaaatccaggccactatggaggaaaacacctatccctccttccttaagtctgatatttatttggaatatacgaggacaggctcggagagccccaaagtctgtagtgaccagagctctgggtcagggacagggaagggcatatctggatacctgccgaccttaaatgaagatgaggaatggaagtgtgaccaggacatggatgaggacgatggcagagacgctgctccccccggaagactccctcagaagctgctcctggagacagctgccccgagggtctcctccagtagacggtacagcgaaggcagagagttcagagggaggaaatggaaagcaaaaaataccccaaagaaggcaagaaagagcaaaaggaagtagagcagatgtgataaaccaacccgatccgacggtggcccagctccctccacatcacactaaatgtaaccggaccagacagcctcattaaaaggaaaaattgttatgctacctttttaaaaggcaggctgcttacacaagtagaagaatatagaatggttaaatgtgaaaagacggaagatgaaagtaccacagtgaccagagagccggtgccgtggccat

SEQ ID NO: 5875 - DNA, 587 bp, synthetic construct
  misc_feature 1..587: note = Synthetic polypeptide
  source 1..587: mol_type = other DNA
atgaacgcgagcagcgagggcgagagcttcgcgggctcggtgcaaattccaggtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacaggccaggcacggtggctcatgcctgtaatcccagcactttcggaggccgaggcgggtggatcacctgaagtgaggagttcatgaccagccttgccaatatggcaaaacaccttctctatgaaaaatacgaaaactagcccagcgtggtgtcacgtgcctgtaatcccagctactcggaaggctaaggcaggagaattgcttggacctgggaggcagaggttgcagtgagctgagatcgtgccactgcactccagcctgggcaacagagtgagactctgtctcaaaaaaataaaaataaaaaa

SEQ ID NO: 5876 - DNA, 581 bp, synthetic construct
  misc_feature 1..581: note = Synthetic polypeptide
  source 1..581: mol_type = other DNA
atgaacgcgagcagcgagggcgagagcttcgcgggctcggtgcaaagtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacaggccaggcacggtggctcatgcctgtaatcccagcactttcggaggccgaggcgggtggatcacctgaagtgaggagttcatgaccagccttgccaatatggcaaaacaccttctctatgaaaaatacgaaaactagcccagcgtggtgtcacgtgcctgtaatcccagctactcggaaggctaaggcaggagaattgcttggacctgggaggcagaggttgcagtgagctgagatcgtgccactgcactccagcctgggcaacagagtgagactctgtctcaaaaaaataaaaataaaaaa

SEQ ID NO: 5877 - DNA, 336 bp, synthetic construct
  misc_feature 1..336: note = Synthetic polypeptide
  source 1..336: mol_type = other DNA
atgaggctgctgtgtggcctgtggctgtggctctccttgctgaaagtcctgcaggcccagaccccaacccccctgccactcccgcccccgatgcagagcttccaaggaaaccagttccagggggaatggttcgtcctgggcctggcgggcaacagcttcaggccggagcacagggcgctgctgaacgctttcaccgcaacttttgagctaagtgatgatggccgctttgaggtgtggaatgcgatgactcgtacttcaggaggcagaggcagaaggatcacttgaactcaggagtttgagaccagcctgagcaacatagttagacaccatctccac

SEQ ID NO: 5878 - DNA, 162 bp, synthetic construct
  misc_feature 1..162: note = Synthetic polypeptide
  source 1..162: mol_type = other DNA
gcgctgctgaacgctttcaccgcaacttttgagctaagtgatgatggccgctttgaggtgtggaatgcgatgactcgtacttcaggaggcagaggcagaaggatcacttgaactcaggagtttgagaccagcctgagcaacatagttagacaccatctccac

SEQ ID NO: 5879 - DNA, 138 bp, synthetic construct
  misc_feature 1..138: note = Synthetic polypeptide
  source 1..138: mol_type = other DNA
acttttgagctaagtgatgatggccgctttgaggtgtggaatgcgatgactcgtacttcaggaggcagaggcagaaggatcacttgaactcaggagtttgagaccagcctgagcaacatagttagacaccatctccac

SEQ ID NO: 5880 - DNA, 734 bp, synthetic construct; identical to SEQ ID NO: 930
  misc_feature 1..734: note = Synthetic polypeptide
  source 1..734: mol_type = other DNA

SEQ ID NO: 5881 - DNA, 643 bp, synthetic construct
  misc_feature 1..643: note = Synthetic polypeptide
  source 1..643: mol_type = other DNA
atgaagaagaagttagtggtgctgggcctgctggccgtggtcctggtgctggtcattgtcggcctctgtctctggctgccctcggcctccaaggaacctgacaaccatgtgtacaccagggctgccatggccgcggatgccaagcagtgcttggagattgggagggacacactgcgggacggtggctctgcagtggatgcagccattgcagccctgttgtgtgtggggctcatgaatgcccacagcatgggcatcggggttggcctcttcctcaccatctacaacagcaccactcgaaaagctgaggtcatcaatgcccgcgaggtggcccccaggctggcctttgccagcatgttcaacagctcggagcagtcccagaaggcactttaggaggccaagtcaggaggagcgcatgagcccaggagacctgcctggacaacatagcaagactccatctctacaaaaaatggaaaaaaaaattagcaggtatggcggtgtgtgcttatggtcccagttactcgggaggctaaggtgggaggatcacttgagcccaggaggttgaggctgcagtcagccatgattataccactacactctagcttgggcaacaaagtgagaccctgtcaaaaaaaaaaaaaaaaaa

SEQ ID NO: 5882 - DNA, 646 bp, synthetic construct
  misc_feature 1..646: note = Synthetic polypeptide
  source 1..646: mol_type = other DNA
atgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaaggcactttaggaggccaagtcaggaggagcgcatgagcccaggagtttgagacctgcctgggcaacatagcaagactccatctctacaaaaaacggaaaaaaaaattagctaggtgtggcggtgtgtgcttatgttcccagctacttgggaggctaaggtgggaggatcacttgagcccaggaggttgaggctgcagtgagccatgattgtaccactacactctagcttgggcaacaaagtgagaccctgccaaaaaaaaaaaaaa

SEQ ID NO: 5883 - DNA, 175 bp, synthetic construct; identical to SEQ ID NO: 5737
  misc_feature 1..175: note = Synthetic polypeptide
  source 1..175: mol_type = other DNA

SEQ ID NO: 5884 - DNA, 1166 bp, synthetic construct; identical to SEQ ID NO: 3328
  misc_feature 1..1166: note = Synthetic polypeptide
  source 1..1166: mol_type = other DNA

SEQ ID NO: 5885 - DNA, 2097 bp, synthetic construct
  misc_feature 1..2097: note = Synthetic polypeptide
  source 1..2097: mol_type = other DNA
atggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattccacattgcaactcacctttaagaaacttctacgtgtcaagttttgaagtggtatcaaaaaagaatacaattatttgaaaagtctattaaaatatgcctcccttttccaactacttatctgtgggaggttggatttccttcatatacttgaatcacaagacgtatctaaatagactgaatggaaaaacatatatgagaatccagttgaaaattattaagccagacattagatttgcaaaaatgtaagataatactctgcctggtaattttttgttactgttttagaaaatagttatttttcattaaaatactattcattatttatgttaacatgtagcgggtttattacatttaagaaatctattagttttaatttcaaatacagtaaatattgataaatacagcctacataagcaaaagttctttggagtcctcaatgatttttttaagagtgtaaaagggtccctagaccaaaacgtt

SEQ ID NO: 5886 - DNA, 1971 bp, synthetic construct
  misc_feature 1..1971: note = Synthetic polypeptide
  source 1..1971: mol_type = other DNA
atgattaatatagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagcagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattccacattgcaactcacctttaagaaacttctacgtgtcaagttttgaagtggtatcaaaaaagaatacaattatttgaaaagtctattaaaatatgcctcccttttccaactacttatctgtgggaggttggatttccttcatatacttgaatcacaagacgtatctaaatagactgaatggaaaaacatatatgagaatccagttgaaaattattaagccagacattagatttgcaaaaatgtaagataatactctgcctggtaattttttgttactgttttagaaaatagttatttttcattaaaatactattcattatttatgttaacatgtagcgggtttattacatttaagaaatctattagttttaatttcaaatacagtaaatattgataaatacagcctacataagcaaaagttctttggagtcctcaatgatttttttaagagtgtaaaagggtccctagaccaaaacgtt

SEQ ID NO: 5887 - DNA, 1746 bp, synthetic construct
  misc_feature 1..1746: note = Synthetic polypeptide
  source 1..1746: mol_type = other DNA
atggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattccacattgcaactcacctttaagaaacttctacgtgtcaagttttgaagtggtatcaaaaaagaatacaattatttgaaaagtctattaaaatatgcctcccttttccaactacttatctgtgggaggttggatttccttcatatacttgaatcacaagacgtatctaaatagactgaatggaaaaacatatatgagaatccagttgaaaattattaagccagacattagatttgcaaaaatgtaagataatactctgcctggtaattttttgttactgttttagaaaatagttatttttcattaaaatactattcattatttatgttaacatgtagcgggtttattacatttaagaaatctattagttttaatttcaaatacagtaaatattgataaatacagcctacataagcaaaagttctttggagtcctcaatgatttttttaagagtgtaaaagggtccctagaccaaaacgtt

SEQ ID NO: 5888 - DNA, 2100 bp, synthetic construct
  misc_feature 1..2100: note = Synthetic polypeptide
  source 1..2100: mol_type = other DNA
atggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagcagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattccacattgcaactcacctttaagaaacttctacgtgtcaagttttgaagtggtatcaaaaaagaatacaattatttgaaaagtctattaaaatatgcctcccttttccaactacttatctgtgggaggttggatttccttcatatacttgaatcacaagacgtatctaaatagactgaatggaaaaacatatatgagaatccagttgaaaattattaagccagacattagatttgcaaaaatgtaagataatactctgcctggtaattttttgttactgttttagaaaatagttatttttcattaaaatactattcattatttatgttaacatgtagcgggtttattacatttaagaaatctattagttttaatttcaaatacagtaaatattgataaatacagcctacataagcaaaagttctttggagtcctcaatgatttttttaagagtgtaaaagggtccctagaccaaaacgtt

SEQ ID NO: 5889 - DNA, 1968 bp, synthetic construct
  misc_feature 1..1968: note = Synthetic polypeptide
  source 1..1968: mol_type = other DNA
atgattaatatagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattccacattgcaactcacctttaagaaacttctacgtgtcaagttttgaagtggtatcaaaaaagaatacaattatttgaaaagtctattaaaatatgcctcccttttccaactacttatctgtgggaggttggatttccttcatatacttgaatcacaagacgtatctaaatagactgaatggaaaaacatatatgagaatccagttgaaaattattaagccagacattagatttgcaaaaatgtaagataatactctgcctggtaattttttgttactgttttagaaaatagttatttttcattaaaatactattcattatttatgttaacatgtagcgggtttattacatttaagaaatctattagttttaatttcaaatacagtaaatattgataaatacagcctacataagcaaaagttctttggagtcctcaatgatttttttaagagtgtaaaagggtccctagaccaaaacgtt

SEQ ID NO: 5890 - DNA, 2094 bp, synthetic construct
  misc_feature 1..2094: note = Synthetic polypeptide
  source 1..2094: mol_type = other DNA
atgagcaaggaggccgtgagcctgtgggcgctcactgtgtccctccaacccccagtccccttgtgtgtctgcagagagatgacaggatcaggcagaagaaaacagcaatgtgtaactttgccattcatctccagagaattatgtttttatcttttgctttttcctccccccaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagcagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattccacattgcaactcacctttaagaaacttctacgtgtcaagttttgaagtggtatcaaaaaagaatacaattatttgaaaagtctattaaaatatgcctcccttttccaactacttatctgtgggaggttggatttccttcatatacttgaatcacaagacgtatctaaatagactgaatggaaaaacatatatgagaatccagttgaaaattattaagccagacattagatttgcaaaaatgtaagataatactctgcctggtaattttttgttactgttttagaaaatagttatttttcattaaaatactattcattatttatgttaacatgtagcgggtttattacatttaagaaatctattagttttaatttcaaatacagtaaatattgataaatacagcctacataagcaaaagttctttggagtcctcaatgatttttttaagagtgtaaaagggtccctagaccaaaacgtt

SEQ ID NO: 5891 - DNA, 281 bp, synthetic construct; identical to SEQ ID NO: 3151
  misc_feature 1..281: note = Synthetic polypeptide
  source 1..281: mol_type = other DNA

SEQ ID NO: 5892 - DNA, 312 bp, synthetic construct
  misc_feature 1..312: note = Synthetic polypeptide
  source 1..312: mol_type = other DNA
atgctggaagttcacatcccgtcggtggggcccgaggccgaggggcccaggcagagcccggagaaaagccacatggtgttccgagtggaggtgctgtgcagcgggcgcagacacacggtgccaaggcgctacagcgagttccacgcgctgcacaagcggatcaagaagctgtacaaagtgcccgacttcccctcgaaacgcctgcccaactggaggaccagagggttggaacagcgccggcagggcttggaggcttacatccaggtccaaacacccccctctggcttgttgaaaggactgaaagaggtaacg

SEQ ID NO: 5893 - DNA, 652 bp, synthetic construct
  misc_feature 1..652: note = Synthetic polypeptide
  source 1..652: mol_type = other DNA
atgaggcgaccaggtagaaaggggactgggggcggccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggtgttgtggcacatgcctatagtcccagctacttaggatgctgagatgggaggatctcttgactccgggaaatcaaagctgccgtgagctgtgagcatgcccctgcactccaggcgatagagc

SEQ ID NO: 5894 - DNA, 760 bp, synthetic construct
  misc_feature 1..760: note = Synthetic polypeptide
  source 1..760: mol_type = other DNA
atggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggtgttgtggcacatgcctatagtcccagctacttaggatgctgagatgggaggatctcttgactccgggaaatcaaagctgccgtgagctgtgagcatgcccctgcactccaggcgatagagc

SEQ ID NO: 5895 - DNA, 1410 bp, synthetic construct
  misc_feature 1..1410: note = Synthetic polypeptide
  source 1..1410: mol_type = other DNA
atgcaggcgggcgccaggttccagcggcggcggcggcagctgcagcagcagcagccccggcggcggcagcctctcctctggccgatggacgcagagccgccgccgccgccgccctgggtctggatggtgccgggctcggccgggctgctccggctcagcgcgggggtcgtggttcccccggtgctgctcgcctcggccccgccgcccgcggccccgctgctccccggtctccccggctggccggccccgagcgagccggtgctcccgctgctgccgctgccctctgcgccagactccgccgccgccgccgccgcgcaccccttccccgcgctccacgggcagtggctgtttggtggccattctccgtccctaggactgcccccctcttccacagtggagctggtgcccgtcttcccacatctctgcccttctgctcttgcaacccctattgggaaaagttggatagacaaaaggattcctaactgtaagatcttttttaataattcctttgctctggactcaacgtggatacatcctgaggagtcaaggtttttccatgggcatgaaaagcctcgtttgctggcaaatcaagtagctgtgtctctgtccaggccggctcctgcctccaggccgctccccacggtggtgttagcacctcagcccatcccaggggtttcaagacgtctttggaggaagtaactgctgatgtggtggaaacagcaagagaactagaagtggaagtggagcttgaagatgtgactgaattgctgaaatctcaaatacaactttaacgcataaggagttacttcttacgagtgaacatagaaagtggtttcttgagatggaatctactcctggtgaagatgttgtaaacattgttgaaataataacaaaggatttagaatattacatagactgagttgataaagcagcagcagggtttgaggggattgactccaattttgaaagttctactgcggctaaaatgctgtcaaacagcattgcatgctacagagacatctttcctgaaaggaagagtccatcaatgtagcaagcgttgctgttgtcttcttttgtgaaattggcacagccaccccagccttcagcaaccaccatcctgatcagtcagcggccatcaacatcgaggcaagaccctccactggcaaaagagttacagtttgctgaaggctcagatgatctctaatattttttagcaataaactatttttaaatttagggatgtacattttttagacataatactattgcacatttaacagactacactatagtgtaaacataacttttgtatgcattggaaaaccaaaaaattcacttgactctctttatcgcaatatttgcgttattgtggtggtctggtactgaacccacgttatctctgaggtttgc

SEQ ID NO: 5896 - DNA, 655 bp, synthetic construct
  misc_feature 1..655: note = Synthetic polypeptide
  source 1..655: mol_type = other DNA
atggcggccaccgggaccgcggccgccgcagccacgggcaggctcctgcttctgctgctggctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggagatgtatccagagctacagatcacaaatgtgatggaggcaaaccagcgggttagtattgacaactggtgccggagggacaaaaagcaatgcaagagtcgctttgttacacctttcaagtgtctcggcgcagtggctcacgcctgtaatcccaacacttggggaggccgaggccggggtggatcacaaggtcagtagatcgagaccatcctggctaacatggtgaaaacccgtctctctactaaaaatacaaaaaaattagacgggcgtggtggcacgtgcctgtagtcccagctacttgggaggctgaggcaggagaatcacttgaacccgggaggcagagtttgtagtgagctgagattgcgccactgcactccagcctgggcagcagagcgagactccatctcaaaaaaaaaaaaaaaaa

SEQ ID NO: 5897 - DNA, 700 bp, synthetic construct
  misc_feature 1..700: note = Synthetic polypeptide
  source 1..700: mol_type = other DNA
atggcggccaccgggaccgcggccgccgcagccacgggcaggctcctgcttctgctgctggtggggctcacggcgcctgccttggcgctggccggctacatcgaggctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggagatgtatccagagctacagatcacaaatgtgatggaggcaaaccagcgggttagtattgacaactggtgccggagggacaaaaagcaatgcaagagtcgctttgttacacctttcaagtgtctcggcgcagtggctcacgcctgtaatcccaacacttggggaggccgaggccggggtggatcacaaggtcagtagatcgagaccatcctggctaacatggtgaaaacccgtctctctactaaaaatacaaaaaaattagacgggcgtggtggcacgtgcctgtagtcccagctacttgggaggctgaggcaggagaatcacttgaacccgggaggcagagtttgtagtgagctgagattgcgccactgcactccagcctgggcagcagagcgagactccatctcaaaaaaaaaaaaaaaaa

SEQ ID NO: 5898 - DNA, 730 bp, synthetic construct
  misc_feature 1..730: note = Synthetic polypeptide
  source 1..730: mol_type = other DNA
atgctgcgagccccgggggagctcccgcgccaggccgcccgctgctccctctgccgcctggggccgggtcgcggacgcgcattttttaagtggcgctgtttgcctgcgtccgtagaccgaggaaacccgctctgggctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggagatgtatccagagctacagatcacaaatgtgatggaggcaaaccagcgggttagtattgacaactggtgccggagggacaaaaagcaatgcaagagtcgctttgttacacctttcaagtgtctcggcgcagtggctcacgcctgtaatcccaacacttggggaggccgaggccggggtggatcacaaggtcagtagatcgagaccatcctggctaacatggtgaaaacccgtctctctactaaaaatacaaaaaaattagacgggcgtggtggcacgtgcctgtagtcccagctacttgggaggctgaggcaggagaatcacttgaacccgggaggcagagtttgtagtgagctgagattgcgccactgcactccagcctgggcagcagagcgagactccatctcaaaaaaaaaaaaaaaaa

SEQ ID NO: 5899 - DNA, 421 bp, synthetic construct
  misc_feature 1..421: note = Synthetic polypeptide
  source 1..421: mol_type = other DNA
atgtatccagagctacagatcacaaatgtgatggaggcaaaccagcgggttagtattgacaactggtgccggagggacaaaaagcaatgcaagagtcgctttgttacacctttcaagtgtctcggcgcagtggctcacgcctgtaatcccaacacttggggaggccgaggccggggtggatcacaaggtcagtagatcgagaccatcctggctaacatggtgaaaacccgtctctctactaaaaatacaaaaaaattagacgggcgtggtggcacgtgcctgtagtcccagctacttgggaggctgaggcaggagaatcacttgaacccgggaggcagagtttgtagtgagctgagattgcgccactgcactccagcctgggcagcagagcgagactccatctcaaaaaaaaaaaaaaaaa

SEQ ID NO: 5900 - DNA, 15330 bp, synthetic construct; identical to SEQ ID NO: 1467
  misc_feature 1..15330: note = Synthetic polypeptide
  source 1..15330: mol_type = other DNA

SEQ ID NO: 5901 - DNA, 15330 bp, synthetic construct; identical to SEQ ID NO: 1468
  misc_feature 1..15330: note = Synthetic polypeptide
  source 1..15330: mol_type = other DNA

SEQ ID NO: 5902 - DNA, 15345 bp, synthetic construct; identical to SEQ ID NO: 1469
  misc_feature 1..15345: note = Synthetic polypeptide
  source 1..15345: mol_type = other DNA

SEQ ID NO: 5903 - DNA, 3012 bp, synthetic construct
  misc_feature 1..3012: note = Synthetic polypeptide
  source 1..3012: mol_type = other DNA
atggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgcctgccccacccagcctgacaaggtccgcaaaattctggacctggtacagagcaagggcgaggaggtgtccgagttcttcctctacttgctccagcaactcgcagatgcctacgtggacctcaggccttggctgctggagatcggcttctccccttccctgctcactcagagcaaagtcgtggtcaacactgacccagtgagcaggtatacccagcagctgcgacaccatctgggccgtgactccaagttcgtgctgtgctatgcccagaaggaggagctgctgctggaggagatctacatggacaccatcatggagctggttggcttcagcaatgagagcctgggcagcctgaacagcctggcctgcctcctggaccacaccaccggcatcctcaatgagcagggtgagaccatcttcatcctgggtgatgctggggtgggcaagtccatgctgctacagcggctgcagagcctctgggccacgggccggctagacgcaggggtcaaattcttcttccactttcgctgccgcatgttcagctgcttcaaggaaagtgacaggctgtgtctgcaggacctgctcttcaagcactactgctacccagagcgggaccccgaggaggtgtttgccttcctgctgcgcttcccccacgtggccctcttcaccttcgatggcctggacgagctgcactcggacttggacctgagccgcgtgcctgacagctcctgcccctgggagcctgcccaccccctggtcttgctggccaacctgctcagtgggaagctgctcaagggggctagcaagctgctcacagcccgcacaggcatcgaggtcccgcgccagttcctgcggaagaaggtgcttctccggggcttctcccccagccacctgcgcgcctatgccaggaggatgttccccgagcgggccctgcaggaccgcctgctgagccagctggaggccaaccccaacctctgcagcctgtgctctgtgcccctcttctgctggatcatcttccggtgcttccagcacttccgtgctgcctttgaaggctcaccacagctgcccgactgcacgatgaccctgacagatgtcttcctcctggtcactgaggtccatctgaacaggatgcagcccagcagcctggtgcagcggaacacacgcagcccagtggagaccctccacgccggccgggacactctgtgctcgctggggcaggtggcccaccggggcatggagaagagcctctttgtcttcacccaggaggaggtgcaggcctccgggctgcaggagagagacatgcagctgggcttcctgcgggctttgccggagctgggccccgggggtgaccagcagtcctatgagtttttccacctcaccctccaggccttctttacagccttcttcctcgtgctggacgacagggtgggcactcaggagctgctcaggttcttccaggagtggatgccccctgcgggggcagcgaccacgtcctgctatcctcccttcctcccgttccagtgcctgcagggcagtggtccggcgcgggaagacctcttcaagaacaaggatcacttccagttcaccaacctcttcctgtgcgggctgttgtccaaagccaaacagaaactcctgcggcatctggtgcccgcggcagccctgaggagaaagcgcaaggccctgtgggcacacctgttttccagcctgcggggctacctgaagagcctgccccgcgttcaggtcgaaagcttcaaccaggtgcaggccatgcccacgttcatctggatgctgcgctgcatctacgagacacagagccagaaggtggggcagctggcggccaggggcatctgcgccaactacctcaagctgacctactgcaacgcctgctcggccgactgcagcgccctctccttcgtcctgcatcacttccccaagcggctggccctagacctagacaacaacaatctcaacgactacggcgtgcgggagctgcagccctgcttcagccgcctcactgttctcagactcagcgtaaaccagatcactgacggtggggtaaaggtgctaagcgaagagctgaccaaatacaaaattgtgacctatttgggtttatacaacaaccagatcaccgatgtcggagccaggtacgtcaccaaaatcctggatgaatgcaaaggcctcacgcatcttaaactgggaaaaaacaaaataacaagtgaaggagggaagtatctcgccctggctgtgaagaacagcaaatcaatctctgaggttgggatgtggggcaatcaagttggggatgaaggagcaaaagccttcgcagaggctctgcggaaccaccccagcttgaccaccctgagtcttgcgtccaacggcatctccacagaaggaggaaagagccttgcgagggccctgcagcagaacacgtctctagaaatactgtggctgacccaaaatgaactcaacgatgaagtggcagagagtttggcagaaatgttgaaagtcaaccagacgttaaagcatttatggcttatccagaatcagatcacagctaaggggactgcccagctggcagatgcgttacagagcaacactggcataacagagatttgaacttgtttggaacttgtcataaaatcgatcagtttggtgaattgcaaccaacaatatttaaaaagaaaacagaacagaacaaaatatcaggatgcaatgtgcatggtatgaaagtatcatttcattcatcttagttcatgcttgcatgtgagtgggtgtgtgtttgcataagtgttggttcacaacataaaatgtaattcttatttagggttgtagacaaaa

SEQ ID NO: 5904 - DNA, 776 bp, synthetic construct; identical to SEQ ID NO: 131
  misc_feature 1..776: note = Synthetic polypeptide
  source 1..776: mol_type = other DNA

SEQ ID NO: 5905 - DNA, 737 bp, synthetic construct; identical to SEQ ID NO: 132
  misc_feature 1..737: note = Synthetic polypeptide
  source 1..737: mol_type = other DNA

SEQ ID NO: 5906 - DNA, 3665 bp, synthetic construct; identical to SEQ ID NO: 2970
  misc_feature 1..3665: note = Synthetic polypeptide
  source 1..3665: mol_type = other DNA

SEQ ID NO: 5907 - DNA, 3377 bp, synthetic construct; identical to SEQ ID NO: 2971
  misc_feature 1..3377: note = Synthetic polypeptide
  source 1..3377: mol_type = other DNA

SEQ ID NO: 5908 - DNA, 2243 bp, synthetic construct; identical to SEQ ID NO: 2972
  misc_feature 1..2243: note = Synthetic polypeptide
  source 1..2243: mol_type = other DNA

SEQ ID NO: 5909 - DNA, 877 bp, synthetic construct
  misc_feature 1..877: note = Synthetic polypeptide
  source 1..877: mol_type = other DNA
atgttccaggcctcaatgaggagtccaaacatggagccattcaagcagcagaaggtggaggacttttatgacatcggagaggagctggggagtggccagtttgccatcgtgaagaagtgccgggagaagagcacggggcttgagtatgcagccaagttcatcaagaagcggcagagccgggcgagccggcgcggtgtgagccgggaggagatcgagcgggaggtgagcatcctgcggcaggtgctgcaccacaatgtcatcacgctgcacgacgtctatgagaaccgcaccgacgtggtgctcatccttgagctagtgtctggaggagagctcttcgatttcctggcccagaaggagtcactgagtgaggaggaggccaccagcttcattaagcagatcctggatggggtgaactaccttcacacaaagaaaattgctcactttgatctcaagccagaaaacattatgttgttagacaagaatattcccattccacacatcaagctgattgactttggtctggctcacgaaatagaagatggagttgaatttaagaatatttttgggacgccggaatttgttgctccagaaattgtgaactacgagcccctgggtctggaggctgacatgtggagcataggcgtcatcacctacatcctcttaagtggagcatcccctttcctgggagacacgaagcaggaaacactggcaaatatcacagcagtgagttacgactttgatgaggaattcttcagccagacgagcgagctggccaaggactttattcggaagcttctggttaaagagacccggaaacggctcacaatccaagaggctctcagacacccctggatcacgggacgtcaccagacttccc

SEQ ID NO: 5910 - DNA, 353 bp, synthetic construct
  misc_feature 1..353: note = Synthetic polypeptide
  source 1..353: mol_type = other DNA
atgaggctgctgtgtggcctgtggctgtggctctccttgctgaaagtcctgcaggcccagaccccaacccccctgccactcccgcccccgatgcagagcttccaaggaaaccagttccagggggaatggttcgtcctgggcctggcgggcaacagcttcaggccggagcacagggcgctgctgaacgctttcaccgcaacttttgagctaagtgatgatggccgctttgaggtgtggaatgcgatgactcggacttcaggggccgggcgcgctggctcacacctgtaatcctagcactttgggggccgggcgcggtcgcgcacacctgtaatcctagcactttgggggccggg

SEQ ID NO: 5911 - DNA, 179 bp, synthetic construct
  misc_feature 1..179: note = Synthetic polypeptide
  source 1..179: mol_type = other DNA
gcgctgctgaacgctttcaccgcaacttttgagctaagtgatgatggccgctttgaggtgtggaatgcgatgactcggacttcaggggccgggcgcgctggctcacacctgtaatcctagcactttgggggccgggcgcggtcgcgcacacctgtaatcctagcactttgggggccggg

SEQ ID NO: 5912 - DNA, 155 bp, synthetic construct
  misc_feature 1..155: note = Synthetic polypeptide
  source 1..155: mol_type = other DNA
acttttgagctaagtgatgatggccgctttgaggtgtggaatgcgatgactcggacttcaggggccgggcgcgctggctcacacctgtaatcctagcactttgggggccgggcgcggtcgcgcacacctgtaatcctagcactttgggggccggg

SEQ ID NO: 5913 - DNA, 3727 bp, synthetic construct; identical to SEQ ID NO: 2946
  misc_feature 1..3727: note = Synthetic polypeptide
  source 1..3727: mol_type = other DNA

SEQ ID NO: 5914 - DNA, 3439 bp, synthetic construct; identical to SEQ ID NO: 2947
  misc_feature 1..3439: note = Synthetic polypeptide
  source 1..3439: mol_type = other DNA

SEQ ID NO: 5915 - DNA, 2305 bp, synthetic construct; identical to SEQ ID NO: 2948
  misc_feature 1..2305: note = Synthetic polypeptide
  source 1..2305: mol_type = other DNA

SEQ ID NO: 5916 - DNA, 1781 bp, synthetic construct
  misc_feature 1..1781: note = Synthetic polypeptide
  source 1..1781: mol_type = other DNA
atgcaggcgggcgccaggttccagcggcggcggcggcagctgcagcagcagcagccccggcggcggcagcctctcctctggccgatggacgcagagccgccgccgccgccgccctgggtctggatggtgccgggctcggccgggctgctccggctcagcgcgggggtcgtggttcccccggtgctgctcgcctcggccccgccgcccgcggccccgctgctccccggtctccccggctggccggccccgagcgagccggtgctcccgctgctgccgctgccctctgcgccagactccgccgccgccgccgccgcgcaccccttccccgcgctccacgggcagtggctgtttggtggccattctccgtccctaggactgcccccctcttccacagtggagctggtgcccgtcttcccacatctctgcccttctgctcttgcaacccctattgggaaaagttggatagacaaaaggattcctaactgtaagatcttttttaataattcctttgctctggactcaacgtggatacatcctgaggagtcaaggtttttccatgggcatgaaaagcctcgtttgctggcaaatcaagtagctgtgtctctgtccaggccggctcctgcctccaggccgctccccacggtggtgttagcacctcagcccatcccaggtggctgccataacagccttaaggtgaccagcagccccgccattgccatcgccaccgccgccgccgctgccatggtctccgtggaccctgagaacctccggggcccgtccccctccagcgtgcagccgcgccacttcctgaccttggcacccatcaaaatacccctccggacgtcccccgtctcagatacaaggacagagcggggccgagtggcccgccctcctgccctgatgctgcgggcccagaagagccgggatggagacaaagaagacaaggagcctccaccgatgctggggggaggagaggacagcacagccagaggcaacaggccagtggcctccaccccggtgcccggatccccctggtgtgtggtctggacgggcgatgaccgagttttcttcttcaacccaacgatgcacctgtctgtctgggagaagcccatggacctgaaggaccgcggagacctcaacaggatcattgaggacccgccccacaaacgcaagctggaggcaccagcaactgacaacagcgatgggtccagttctgaagacaacagggaagaccaagatgtgaaaaccaagaggaaccggaccgaaggctgcgggagtcccaagccagaggaggcaaagagagaggacaaaggcacaaggacgccgcccccgcagatcctcctgcctctggaggagcgtgtgacccacttccgagacatgctgctggagagaggggctatttacgaggaaaacctcagacaaatcccaactgaggagtgtcctgcaatgcacctgaccagggctcctcaaaccatcaaggtcatcaacggcaagggccatctgagaccctgtcacagccaagaggagtccaaggagatatggcagcgaaatgtgatgaggtccttggcagaaatggaaaattgggtaaaacctaaagaaatctgaataaatgcagactattgttagtaataatgcgtcatggttagtggtgacgaatctagcctactaatatgttaacgacgtgagaaactgggtatgagtatatggtaactttctgtaatattcttgcaaatttttagtacgtctaaaactattgcaaacaaaataatttatttttaaaa

SEQ ID NO: 5917 - DNA, 1789 bp, synthetic construct; identical to SEQ ID NO: 4563
  misc_feature 1..1789: note = Synthetic polypeptide
  source 1..1789: mol_type = other DNA

SEQ ID NO: 5918 - DNA, 553 bp, synthetic construct; identical to SEQ ID NO: 4564
  misc_feature 1..553: note = Synthetic polypeptide
  source 1..553: mol_type = other DNA

SEQ ID NO: 5919 - DNA, 1807 bp, synthetic construct; identical to SEQ ID NO: 4565
  misc_feature 1..1807: note = Synthetic polypeptide
  source 1..1807: mol_type = other DNA

SEQ ID NO: 5920 - DNA, 1637 bp, synthetic construct
  misc_feature 1..1637: note = Synthetic polypeptide
  source 1..1637: mol_type = other DNA
atgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgactggacattaccctgaattctactagttcctccaattccattttcttccatggaatcgctaagaaaaagacccactctgttccagaagccctataagctggaggtggacaactcaatgtaaatttcatgggaaaacccttgtacctgaagggtgagccactcagaactcactaaaatgttcgacaccataacaacagatgctcaaactgtaaaccaggacaacaagtggatgacttcacactgtggacagtttttcccaagatgtcagaacaagactccccatcatgatgaggctctcacccctcttaactgtccttgctcatgcctgcctctttcacttggcaggataatgcagtcattagaatttcacatgtagtagcttctgagggtaac

SEQ ID NO: 5921 - DNA, 1358 bp, synthetic construct
  misc_feature 1..1358: note = Synthetic polypeptide
  source 1..1358: mol_type = other DNA
atgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgactggacattaccctgaattctactagttcctccaattccattttcttccatggaatcgctaagaaaaagacccactctgttccagaagccctataagctggaggtggacaactcaatgtaaatttcatgggaaaacccttgtacctgaagggtgagccactcagaactcactaaaatgttcgacaccataacaacagatgctcaaactgtaaaccaggacaacaagtggatgacttcacactgtggacagtttttcccaagatgtcagaacaagactccccatcatgatgaggctctcacccctcttaactgtccttgctcatgcctgcctctttcacttggcaggataatgcagtcattagaatttcacatgtagtagcttctgagggtaac

SEQ ID NO: 5922 - DNA, 1119 bp, synthetic construct
  misc_feature 1..1119: note = Synthetic polypeptide
  source 1..1119: mol_type = other DNA
atcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctccatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgactggacattaccctgaattctactagttcctccaattccattttcttccatggaatcgctaagaaaaagacccactctgttccagaagccctataagctggaggtggacaactcaatgtaaatttcatgggaaaacccttgtacctgaagggtgagccactcagaactcactaaaatgttcgacaccataacaacagatgctcaaactgtaaaccaggacaacaagtggatgacttcacactgtggacagtttttcccaagatgtcagaacaagactccccatcatgatgaggctctcacccctcttaactgtccttgctcatgcctgcctctttcacttggcaggataatgcagtcattagaatttcacatgtagtagcttctgagggtaac

SEQ ID NO: 5923 - DNA, 1239 bp, synthetic construct; identical to SEQ ID NO: 129
  misc_feature 1..1239: note = Synthetic polypeptide
  source 1..1239: mol_type = other DNA

SEQ ID NO: 5924 - DNA, 1200 bp, synthetic construct; identical to SEQ ID NO: 130
  misc_feature 1..1200: note = Synthetic polypeptide
  source 1..1200: mol_type = other DNA

SEQ ID NO: 5925 - DNA, 2501 bp, synthetic construct; identical to SEQ ID NO: 1164
  misc_feature 1..2501: note = Synthetic polypeptide
  source 1..2501: mol_type = other DNA

SEQ ID NO: 5926 - DNA, 2552 bp, synthetic construct; identical to SEQ ID NO: 1165
  misc_feature 1..2552: note = Synthetic polypeptide
  source 1..2552: mol_type = other DNA

SEQ ID NO: 5927 - DNA, 2456 bp, synthetic construct; identical to SEQ ID NO: 1166
  misc_feature 1..2456: note = Synthetic polypeptide
  source 1..2456: mol_type = other DNA

SEQ ID NO: 5928 - DNA, 588 bp, synthetic construct; identical to SEQ ID NO: 1167
  misc_feature 1..588: note = Synthetic polypeptide
  source 1..588: mol_type = other DNA

SEQ ID NO: 5929 - DNA, 861 bp, synthetic construct
  misc_feature 1..861: note = Synthetic polypeptide
  source 1..861: mol_type = other DNA
atgcggctgctggcactggcggcggccgcgctgctggcgcgggctccggctccggaggtctgtgcggccctcaatgtcactgtgtccccggggcccgtggttgactacctggagggggagaatgccactctcctctgccacgtctcccagaaaaggcggaaggacagcttgctggccgtgcgctggttctttgcacactccttcgactcccaggaggccttgatggtgaagatgaccaagctccgggtggtgcagtactatgggaatttcagccgcagcgccaaacggcggaggctgcgcctgctggaggagcagcggggggcgctctacaggctctccgtcttgacactgcagccctccgatcaagggcattacgtctgcagagtccaggaaatcagcaggcacaggaacaagtggacggcctggtccaatggctcctcagccacggaaatgagagtcatttccctcaaagcttctgaagagtcatcctttgagaaaacaaaagagacttgggcattttttgaagatctctatgtgtatgctgtcctcgtgtgctgcgtggggatcctcagcattctgctcttcatgctggtcatcgtctggcagtctgtgtttaacaagcggaaatccagagtgagacattatttggtgaaatgccctcagaacagctcaggggagactgtcactagcgtgaccagcttggccccactacagcccaagaagggcaagaggcagaaggagaagcctgacattcctcccgcagtccctgccaaagctccgatagcccccacgttccataaaccgaagctgctgaaaccacagagaaaagtcacgctgcctgttgtcaacatttatccacac

SEQ ID NO: 5930 - DNA, 858 bp, synthetic construct; identical to SEQ ID NO: 4891
  misc_feature 1..858: note = Synthetic polypeptide
  source 1..858: mol_type = other DNA

SEQ ID NO: 5931 - DNA, 340 bp, synthetic construct; identical to SEQ ID NO: 4892
  misc_feature 1..340: note = Synthetic polypeptide
  source 1..340: mol_type = other DNA

SEQ ID NO: 5932 - DNA, 657 bp, synthetic construct; identical to SEQ ID NO: 180
  misc_feature 1..657: note = Synthetic polypeptide
  source 1..657: mol_type = other DNA

SEQ ID NO: 5933 - DNA, 423 bp, synthetic construct; identical to SEQ ID NO: 179
  misc_feature 1..423: note = Synthetic polypeptide
  source 1..423: mol_type = other DNA

SEQ ID NO: 5934 - DNA, 3308 bp, synthetic construct; identical to SEQ ID NO: 428
  misc_feature 1..3308: note = Synthetic polypeptide
  source 1..3308: mol_type = other DNA

SEQ ID NO: 5935 - DNA, 3203 bp, synthetic construct; identical to SEQ ID NO: 429
  misc_feature 1..3203: note = Synthetic polypeptide
  source 1..3203: mol_type = other DNA

SEQ ID NO: 5936 - DNA, 2849 bp, synthetic construct; identical to SEQ ID NO: 430
  misc_feature 1..2849: note = Synthetic polypeptide
  source 1..2849: mol_type = other DNA

SEQ ID NO: 5937 - DNA, 388 bp, synthetic construct; identical to SEQ ID NO: 431
  misc_feature 1..388: note = Synthetic polypeptide
  source 1..388: mol_type = other DNA

SEQ ID NO: 5938 - DNA, 321 bp, synthetic construct; identical to SEQ ID NO: 1173
  misc_feature 1..321: note = Synthetic polypeptide
  source 1..321: mol_type = other DNA

SEQ ID NO: 5939 - DNA, 267 bp, synthetic construct; identical to SEQ ID NO: 1174
  misc_feature 1..267: note = Synthetic polypeptide
  source 1..267: mol_type = other DNA

SEQ ID NO: 5940 - DNA, 238 bp, synthetic construct; identical to SEQ ID NO: 1175
  misc_feature 1..238: note = Synthetic polypeptide
  source 1..238: mol_type = other DNA

SEQ ID NO: 5941 - DNA, 495 bp, synthetic construct; identical to SEQ ID NO: 5854
  misc_feature 1..495: note = Synthetic polypeptide
  source 1..495: mol_type = other DNA

SEQ ID NO: 5942 - DNA, 270 bp, synthetic construct; identical to SEQ ID NO: 5855
  misc_feature 1..270: note = Synthetic polypeptide
  source 1..270: mol_type = other DNA

SEQ ID NO: 5943 - DNA, 445 bp, synthetic construct
  misc_feature 1..445: note = Synthetic polypeptide
  source 1..445: mol_type = other DNA
atgagctgtaagaagcagaggtcacggaagcactcagtcaatgaaaaatgtaatatgaaaatcgagcactatttttctccggtctctaaagagcaacagaataattgcagtacttctctaatgaggatggagtctagaggagacccaagagccacaactaatacccaggctcaaagattccattcacctaagaaaaatccagaagaccagaccatgccccaaaataggacaatatatgttaccttgaagactatatagatgattcaaccaagcctgcaaatctccctcttgtggaattccactggacccaatctgttttccatttccattgcaatactactaaagccatacaatatcaagcaccctccctctaggtccagggactatcacagaagaagcaggcatgtaagattttaaggactggtttcgaggggtcgagtgtagg

SEQ ID NO: 5944 - DNA, 381 bp, synthetic construct; identical to SEQ ID NO: 201
  misc_feature 1..381: note = Synthetic polypeptide
  source 1..381: mol_type = other DNA

SEQ ID NO: 5945 - DNA, 732 bp, synthetic construct
  misc_feature 1..732: note = Synthetic polypeptide
  source 1..732: mol_type = other DNA
atgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagacttgtcaaatcagaatctct

SEQ ID NO: 5946 - DNA, 1386 bp, synthetic construct
  misc_feature 1..1386: note = Synthetic polypeptide
  source 1..1386: mol_type = other DNA
atggcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcagatgccacagtggagctatccttggacagcacacaaaataatcagaagaaggtgctagccaaaacactcatttctcttcctcctcaggaagccacaaattcttcgaagccccagccaacctatgaggagctagaggaagaagaacaggaggatcaatttgatttgacagtcggtataactgatcctgagaagataggggatggtatgaatgcatatgtagcctacaaagttacaacacagacaagcttaccattgttcagaagcaaacagtttgcagtaaaaagaagatttagtgactttctgggtctttatgagaagctttccgagaagcactctcagaatggcttcattgtccctccgcccccggagaagagcctcatagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagacttgtcaaatcagaatctct

SEQ ID NO: 5947 - DNA, 1191 bp, synthetic construct
  misc_feature 1..1191: note = Synthetic polypeptide
  source 1..1191: mol_type = other DNA
atggcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcaggggatggtatgaatgcatatgtagcctacaaagttacaacacagacaagcttaccattgttcagaagcaaacagtttgcagtaaaaagaagatttagtgactttctgggtctttatgagaagctttccgagaagcactctcagaatggcttcattgtccctccgcccccggagaagagcctcatagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagacttgtcaaatcagaatctct

SEQ ID NO: 5948 - DNA, 137 bp, synthetic construct; identical to SEQ ID NO: 336
  misc_feature 1..137: note = Synthetic polypeptide
  source 1..137: mol_type = other DNA

SEQ ID NO: 5949 - DNA, 976 bp, synthetic construct; identical to SEQ ID NO: 2334
  misc_feature 1..976: note = Synthetic polypeptide
  source 1..976: mol_type = other DNA

SEQ ID NO: 5950 - DNA, 1009 bp, synthetic construct; identical to SEQ ID NO: 2335
  misc_feature 1..1009: note = Synthetic polypeptide
  source 1..1009: mol_type = other DNA

SEQ ID NO: 5951 - DNA, 1132 bp, synthetic construct; identical to SEQ ID NO: 2336
  misc_feature 1..1132: note = Synthetic polypeptide
  source 1..1132: mol_type = other DNA

SEQ ID NO: 5952 - DNA, 563 bp, synthetic construct; identical to SEQ ID NO: 2337
  misc_feature 1..563: note = Synthetic polypeptide
  source 1..563: mol_type = other DNA

SEQ ID NO: 5953 - DNA, 1917 bp, synthetic construct
  misc_feature 1..1917: note = Synthetic polypeptide
  source 1..1917: mol_type = other DNA
atggaagcagaaacagggagcagcgtggagactggaaagaaggccaacagaggcactcgaattgccctggtcgtgtttgtcggtggcaccctagttctgggcacgatcctctttctagtgagtcaaggtctcttaagtctccaagctaaacaggagtactgcctgaagccagaatgcatcgaagcggctgctgccatcttaagtaaagtaaatctgtctgtggatccttgtgataatttcttccggttcgcttgtgatggctggataagcaataatccaattcccgaagatatgccaagctatggggtttatccttggctgagacataatgttgacctcaagttgaaggaacttttggagaaatcaatcagtagaaggcgggacaccgaagccatacagaaagccaaaatcctttattcatcctgcatgaatgagaaagcgattgaaaaagcagatgccaagccactgctacacatcctacggcattcacctttccgctggcccgtgcttgaatctaatattggccctgaaggggtttggtcagagagaaagttcagccttctgcagacacttgcaacgtttcgtggtcaatacagcaattctgtgttcatccgtttgtatgtgtcccctgatgacaaagcatccaatgaacatatcttgaagctggaccaagcaacactctccctggccgtgagggaagactaccttgataacagtacagaagccaagtcttatcgggatgccctttacaagttcatggtggatactgccgtgcttttaggagctaacagttccagagcagagcatgacatgaagtcagtgctcagattggaaattaagatagctgagataatgattccacatgaaaaccgaaccagcgaggccatgtacaacaaaatgaacatttctgaactgagtgctatgattccccagttcgactggctgggctacatcaagaaggtcattgacaccagactctacccccatctgaaagacatcagcccctccgagaatgtggtggtccgcgtcccgcagtactttaaagatttgtttaggatattagggtctgagagaaagaagaccattgccaactatttggtgtggagaatggtttattccagaattccaaaccttagcaggcgctttcagtatagatggctggaattctcaagggtaatccaggggaccacaactttgctgcctcaatgggacaaatgtgtaaactttattgaaagtgccctcccttatgttgttggaaagatgtttgtagatgtgtacttccaggaagataagaaggaaatgatggaggaattggttgagggcgttcgctgggcctttattgacatgctagagaaagaaaatgagtggatggatgcaggaacgaaaaggaaagccaaagaaaaggcgagagctgttttggcaaaagttggctatccagagtttataatgaatgatactcatgttaatgaagacctcaaagctatcaagttttcagaagccgactactttggcaacgtcctacaaactcgcaagtatttagcacagtctgatttcttctggctaagaaaagccgttccaaaaacagagtggtttacaaatccgacgactgtcaatgccttctacagtgcatccaccaaccagatccgaagatgagtcacatgtggcatattcacacaaaggaataccatacagcagtgaaaaatgagcaacatatattaacatggatgaatttcacaagtaaaacaacttgggaaaatatatcaagtatgatactatataaataaagttgaaaatcatgcagaacaattctacacatggtttggaggtccatccatttgtagtgtaagtgtaaagacattcatgagaatgacaaacaccaaattccggttggtggtggcttgtcttggggagggtggg

SEQ ID NO: 5954 - DNA, 1626 bp, synthetic construct
  misc_feature 1..1626: note = Synthetic polypeptide
  source 1..1626: mol_type = other DNA
atgccaagctatggggtttatccttggctgagacataatgttgacctcaagttgaaggaacttttggagaaatcaatcagtagaaggcgggacaccgaagccatacagaaagccaaaatcctttattcatcctgcatgaatgagaaagcgattgaaaaagcagatgccaagccactgctacacatcctacggcattcacctttccgctggcccgtgcttgaatctaatattggccctgaaggggtttggtcagagagaaagttcagccttctgcagacacttgcaacgtttcgtggtcaatacagcaattctgtgttcatccgtttgtatgtgtcccctgatgacaaagcatccaatgaacatatcttgaagctggaccaagcaacactctccctggccgtgagggaagactaccttgataacagtacagaagccaagtcttatcgggatgccctttacaagttcatggtggatactgccgtgcttttaggagctaacagttccagagcagagcatgacatgaagtcagtgctcagattggaaattaagatagctgagataatgattccacatgaaaaccgaaccagcgaggccatgtacaacaaaatgaacatttctgaactgagtgctatgattccccagttcgactggctgggctacatcaagaaggtcattgacaccagactctacccccatctgaaagacatcagcccctccgagaatgtggtggtccgcgtcccgcagtactttaaagatttgtttaggatattagggtctgagagaaagaagaccattgccaactatttggtgtggagaatggtttattccagaattccaaaccttagcaggcgctttcagtatagatggctggaattctcaagggtaatccaggggaccacaactttgctgcctcaatgggacaaatgtgtaaactttattgaaagtgccctcccttatgttgttggaaagatgtttgtagatgtgtacttccaggaagataagaaggaaatgatggaggaattggttgagggcgttcgctgggcctttattgacatgctagagaaagaaaatgagtggatggatgcaggaacgaaaaggaaagccaaagaaaaggcgagagctgttttggcaaaagttggctatccagagtttataatgaatgatactcatgttaatgaagacctcaaagctatcaagttttcagaagccgactactttggcaacgtcctacaaactcgcaagtatttagcacagtctgatttcttctggctaagaaaagccgttccaaaaacagagtggtttacaaatccgacgactgtcaatgccttctacagtgcatccaccaaccagatccgaagatgagtcacatgtggcatattcacacaaaggaataccatacagcagtgaaaaatgagcaacatatattaacatggatgaatttcacaagtaaaacaacttgggaaaatatatcaagtatgatactatataaataaagttgaaaatcatgcagaacaattctacacatggtttggaggtccatccatttgtagtgtaagtgtaaagacattcatgagaatgacaaacaccaaattccggttggtggtggcttgtcttggggagggtggg

SEQ ID NO: 5955 - DNA, 1026 bp, synthetic construct
  misc_feature 1..1026: note = Synthetic polypeptide
  source 1..1026: mol_type = other DNA
atgatccacctgcctcggcctcccaaagtgctgggattacagttcgactggctgggctacatcaagaaggtcattgacaccagactctacccccatctgaaagacatcagcccctccgagaatgtggtggtccgcgtcccgcagtactttaaagatttgtttaggatattagggtctgagagaaagaagaccattgccaactatttggtgtggagaatggtttattccagaattccaaaccttagcaggcgctttcagtatagatggctggaattctcaagggtaatccaggggaccacaactttgctgcctcaatgggacaaatgtgtaaactttattgaaagtgccctcccttatgttgttggaaagatgtttgtagatgtgtacttccaggaagataagaaggaaatgatggaggaattggttgagggcgttcgctgggcctttattgacatgctagagaaagaaaatgagtggatggatgcaggaacgaaaaggaaagccaaagaaaaggcgagagctgttttggcaaaagttggctatccagagtttataatgaatgatactcatgttaatgaagacctcaaagctatcaagttttcagaagccgactactttggcaacgtcctacaaactcgcaagtatttagcacagtctgatttcttctggctaagaaaagccgttccaaaaacagagtggtttacaaatccgacgactgtcaatgccttctacagtgcatccaccaaccagatccgaagatgagtcacatgtggcatattcacacaaaggaataccatacagcagtgaaaaatgagcaacatatattaacatggatgaatttcacaagtaaaacaacttgggaaaatatatcaagtatgatactatataaataaagttgaaaatcatgcagaacaattctacacatggtttggaggtccatccatttgtagtgtaagtgtaaagacattcatgagaatgacaaacaccaaattccggttggtggtggcttgtcttggggagggtggg

SEQ ID NO: 5956 - DNA, 12492 bp, synthetic construct; identical to SEQ ID NO: 3203
  misc_feature 1..12492: note = Synthetic polypeptide
  source 1..12492: mol_type = other DNA

SEQ ID NO: 5957 - DNA, 12567 bp, synthetic construct; identical to SEQ ID NO: 3204
  misc_feature 1..12567: note = Synthetic polypeptide
  source 1..12567: mol_type = other DNA

SEQ ID NO: 5958 - DNA, 9032 bp, synthetic construct; identical to SEQ ID NO: 3205
  misc_feature 1..9032: note = Synthetic polypeptide
  source 1..9032: mol_type = other DNA

SEQ ID NO: 5959 - DNA, 561 bp, synthetic construct; identical to SEQ ID NO: 3206
  misc_feature 1..561: note = Synthetic polypeptide
  source 1..561: mol_type = other DNA

SEQ ID NO: 5960 - DNA, 134 bp, synthetic construct
  misc_feature 1..134: note = Synthetic polypeptide
  source 1..134: mol_type = other DNA
atgcgctacgtcgcctcctacctgctggctgccctagggggcaactcctcccccagcgccaaggacatcaagaagatcttggacagcgtgggtatcgaggcggacgacgaccggctcaacaaggaagtcgaggc

SEQ ID NO: 5961 - DNA, 1061 bp, synthetic construct; identical to SEQ ID NO: 4766
  misc_feature 1..1061: note = Synthetic polypeptide
  source 1..1061: mol_type = other DNA

SEQ ID NO: 5962 - DNA, 1058 bp, synthetic construct; identical to SEQ ID NO: 4767
  misc_feature 1..1058: note = Synthetic polypeptide
  source 1..1058: mol_type = other DNA

SEQ ID NO: 5963 - DNA, 1031 bp, synthetic construct; identical to SEQ ID NO: 4768
  misc_feature 1..1031: note = Synthetic polypeptide
  source 1..1031: mol_type = other DNA

SEQ ID NO: 5964 - DNA, 2818 bp, synthetic construct
  misc_feature 1..2818: note = Synthetic polypeptide
  source 1..2818: mol_type = other DNA
atgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaagcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgacaccagatttgactagaacagtaagcttttctgtttatctgaaaagaagttatacaccatcagaattggaaggaaatgctgttgtttcttattccagaccaacagatcgaaatcctgatggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctggtggagttttcctgcacaagctctctttgcttgctgccatccatgtaagatgtgacttgctcctccttgccttccaccatgattgtgaggctaccccagccacatggaactgtaagtccaattaaacctctttcttttctaaattgcccagtcttgagtatgtctttatcagcagcacgaaaacag

SEQ ID NO: 5965 - DNA, 2698 bp, synthetic construct
  misc_feature 1..2698: note = Synthetic polypeptide
  source 1..2698: mol_type = other DNA
atgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaagcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgagcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctggtggagttttcctgcacaagctctctttgcttgctgccatccatgtaagatgtgacttgctcctccttgccttccaccatgattgtgaggctaccccagccacatggaactgtaagtccaattaaacctctttcttttctaaattgcccagtcttgagtatgtctttatcagcagcacgaaaacag

SEQ ID NO: 5966 - DNA, 2713 bp, synthetic construct
  misc_feature 1..2713: note = Synthetic polypeptide
  source 1..2713: mol_type = other DNA
atgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaagcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgagtctgaatgttttaggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctggtggagttttcctgcacaagctctctttgcttgctgccatccatgtaagatgtgacttgctcctccttgccttccaccatgattgtgaggctaccccagccacatggaactgtaagtccaattaaacctctttcttttctaaattgcccagtcttgagtatgtctttatcagcagcacgaaaacag

SEQ ID NO: 5967 - DNA, 2803 bp, synthetic construct
  misc_feature 1..2803: note = Synthetic polypeptide
  source 1..2803: mol_type = other DNA
atgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaagcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgacaccagatttgactagaacagtaagcttttctgtttatctgaaaagaagttatacaccatcagaattggaaggaaatgctgttgtttcttattccagaccaacaggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctggtggagttttcctgcacaagctctctttgcttgctgccatccatgtaagatgtgacttgctcctccttgccttccaccatgattgtgaggctaccccagccacatggaactgtaagtccaattaaacctctttcttttctaaattgcccagtcttgagtatgtctttatcagcagcacgaaaacag

SEQ ID NO: 5968 - DNA, 2713 bp, synthetic construct
  misc_feature 1..2713: note = Synthetic polypeptide
  source 1..2713: mol_type = other DNA
atgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaagcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgaatcgaaatcctgatggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctggtggagttttcctgcacaagctctctttgcttgctgccatccatgtaagatgtgacttgctcctccttgccttccaccatgattgtgaggctaccccagccacatggaactgtaagtccaattaaacctctttcttttctaaattgcccagtcttgagtatgtctttatcagcagcacgaaaacag

SEQ ID NO: 5969 - DNA, 1517 bp, synthetic construct
  misc_feature 1..1517: note = Synthetic polypeptide
  source 1..1517: mol_type = other DNA
tgaccttgtcccttctgtcacggtgaaggtcacactgcagaacagagtgatattgcaaaaagccaaattatcagtctacgtgcaaccaccattagaattgacttgtgatcagttcacctttgaatttatgacaccagatttgactagaacagtaagcttttctgtttatctgaaaagaagttatacaccatcagaattggaaggaaatgctgttgtttcttattccagaccaacagatcgaaatcctgatggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctggtggagttttcctgcacaagctctctttgcttgctgccatccatgtaagatgtgacttgctcctccttgccttccaccatgattgtgaggctaccccagccacatggaactgtaagtccaattaaacctctttcttttctaaattgcccagtcttgagtatgtctttatcagcagcacgaaaacag

SEQ ID NO: 5970 - DNA, 3525 bp, synthetic construct; identical to SEQ ID NO: 214
  misc_feature 1..3525: note = Synthetic polypeptide
  source 1..3525: mol_type = other DNA

SEQ ID NO: 5971 - DNA, 1654 bp, synthetic construct; identical to SEQ ID NO: 1385
  misc_feature 1..1654: note = Synthetic polypeptide
  source 1..1654: mol_type = other DNA

SEQ ID NO: 5972 - DNA, 632 bp, synthetic construct; identical to SEQ ID NO: 1386
  misc_feature 1..632: note = Synthetic polypeptide
  source 1..632: mol_type = other DNA

SEQ ID NO: 5973 - DNA, 1357 bp, synthetic construct
  misc_feature 1..1357: note = Synthetic polypeptide
  source 1..1357: mol_type = other DNA
atggggcccctctcagcccctccctgcacacagcacatcacctggaaggggctcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagctactggcaaggaaagctccaaatccatgacagtcgaagtctctgactggacattaccctgaattctactagttcctccaattccatcttctcccatggaacctcaaagagcaagacccactctgttccagaagccctataagccagagttggacaactcaatgtaaatttcatgggaaaatccttgtacctgatgtctgagccactcagaactcaccaaaatgttcaacaccataacaacagctgctcaaactgtaaacaaggaaaacaagttgatgacttcacacgtggacagtttttcccaagatgtcagaataagactccccatcatgatgaggctctcacccctcttagctgtccttgcttgtgcctgcctctttcacttggcaggataatgcagtcattagaatttcacatgtagtagcttctgagggtaac

SEQ ID NO: 5974 - DNA, 1636 bp, synthetic construct
  misc_feature 1..1636: note = Synthetic polypeptide
  source 1..1636: mol_type = other DNA
atggggcccctctcagcccctccctgcacacagcacatcacctggaaggggctcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctggaaactcccaagccctccatctccagtagcaacttaaaccccagggaggccatggaggctgtgatcttaacctgtgatcctgcggcttcagacacaagctacctgtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccacagtgacccagtcaccctgaatctcctcctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagctactggcaaggaaagctccaaatccatgacagtcgaagtctctgactggacattaccctgaattctactagttcctccaattccatcttctcccatggaacctcaaagagcaagacccactctgttccagaagccctataagccagagttggacaactcaatgtaaatttcatgggaaaatccttgtacctgatgtctgagccactcagaactcaccaaaatgttcaacaccataacaacagctgctcaaactgtaaacaaggaaaacaagttgatgacttcacacgtggacagtttttcccaagatgtcagaataagactccccatcatgatgaggctctcacccctcttagctgtccttgcttgtgcctgcctctttcacttggcaggataatgcagtcattagaatttcacatgtagtagcttctgagggtaac

SEQ ID NO: 5975 - DNA, 1151 bp, synthetic construct
  misc_feature 1..1151: note = Synthetic polypeptide
  source 1..1151: mol_type = other DNA
atgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggcttcagtggagccctactgtgctgacatcaccagcgaggaggtccgcacacttgaggagttactgaagcccccagaagatgaggctgagcattacaagatcccacccctggggaagcactactcccagcgctgggcccaggaggacctgctggaggagcagaaggatggggcccgggcagcggctgtggctgacaagaagaaaggcctcatggggccactgaccgaactggacactaaagatgtggatgccctgctgaagaagtctgaggcccagcatgaacagccggaagatggatgcccctttggtgccctgacgcagcgcctcctgcaggccctggtggaggaaaatattatttcccctatggaggattctcctattcctgacatgtctgggaaagaatcaggggctgacggggcaagcacctcccctcgcaatcagaacaagcccttcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaccgcaccaagaagcacgacctgctgaggctggactcaatcactaagtgaccttccagctccaccatcgatga

SEQ ID NO: 5976 - DNA, 1358 bp, synthetic construct
  misc_feature 1..1358: note = Synthetic polypeptide
  source 1..1358: mol_type = other DNA
atggggcccctctcagcccctccctgcacacagcacatcacctggaaggggctcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagctactggcaaggaaagctccaaatccatgacagtcgaagtctctgactggacattaccctgaattctactagttcctccaattccattttctcccatggaatcactaagaccaagacccactctgttccagaagccctataagtgggaggaggacaactcaatgtaaatttcatgggaaaattcttgtacctgaagtgtgagccactcagaactcaccaaaatgttggacagcataacaacagatgctcaaactgtaaaccaggacaacaagttgatgacttcacactgtggacagttctccccaagatgtcaaaataagactccccatcatgatgaggctctcgcccctcttaactgtccttgctcatgcatgcctctttcatttggcaggataatgcagtcattagaatttcacatgtagtagcttctgagggtaac

SEQ ID NO: 5977 - DNA, 1637 bp, synthetic construct
  misc_feature 1..1637: note = Synthetic polypeptide
  source 1..1637: mol_type = other DNA
atggggcccctctcagcccctccctgcacacagcacatcacctggaaggggctcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctggaaactcccaagccctccatctccagtagcaacttaaaccccagggaggccatggaggctgtgatcttaacctgtgatcctgcggcttcagacacaagctacctgtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccacagtgacccagtcaccctgaatctcctcctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagctactggcaaggaaagctccaaatccatgacagtcgaagtctctgactggacattaccctgaattctactagttcctccaattccattttctcccatggaatcactaagaccaagacccactctgttccagaagccctataagtgggaggaggacaactcaatgtaaatttcatgggaaaattcttgtacctgaagtgtgagccactcagaactcaccaaaatgttggacagcataacaacagatgctcaaactgtaaaccaggacaacaagttgatgacttcacactgtggacagttctccccaagatgtcaaaataagactccccatcatgatgaggctctcgcccctcttaactgtccttgctcatgcatgcctctttcatttggcaggataatgcagtcattagaatttcacatgtagtagcttctgagggtaac

SEQ ID NO: 5978 - DNA, 1363 bp, synthetic construct
  misc_feature 1..1363: note = Synthetic polypeptide
  source 1..1363: mol_type = other DNA
atggggcccctctcagcccctccctgcacacagcacatcacctggaaggggctcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagctactggcaaggaaagctccaaatccatgacagtcgaagtctctgactggacattaccctgaattctactagttcctccaattccatcttctcccatggaacctcaaagagcaagacccactctgttccagaagccctataagtcagagttggacaactcaatgtaaatttcatgggaaaatccttgtacctgatgtctgagccactcagaactcaccaaaatgttcaacaccataacaacagctgctcaaactgtaaacaaggaaaacaagttgatgacttcacactgtggacagcttttcccaagatgtcagaataagactccccatcatgatgaggctctcacccctcttagctgtccttgcttgtgcctgcctctttcacttggcaggataatgcagtcattagaatttcacatgtagtataggagcttctgagggtaac

SEQ ID NO: 5979 - DNA, 1642 bp, synthetic construct
  misc_feature 1..1642: note = Synthetic polypeptide
  source 1..1642: mol_type = other DNA
atggggcccctctcagcccctccctgcacacagcacatcacctggaaggggctcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctggaaactcccaagccctccatctccagtagcaacttaaaccccagggaggccatggaggctgtgatcttaacctgtgatcctgcggcttcagacacaagctacctgtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccacagtgacccagtcaccctgaatctcctcctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagctactggcaaggaaagctccaaatccatgacagtcgaagtctctgactggacattaccctgaattctactagttcctccaattccatcttctcccatggaacctcaaagagcaagacccactctgttccagaagccctataagtcagagttggacaactcaatgtaaatttcatgggaaaatccttgtacctgatgtctgagccactcagaactcaccaaaatgttcaacaccataacaacagctgctcaaactgtaaacaaggaaaacaagttgatgacttcacactgtggacagcttttcccaagatgtcagaataagactccccatcatgatgaggctctcacccctcttagctgtccttgcttgtgcctgcctctttcacttggcaggataatgcagtcattagaatttcacatgtagtataggagcttctgagggtaac

SEQ ID NO: 5980 - DNA, 500 bp, synthetic construct
  misc_feature 1..500: note = Synthetic polypeptide
  source 1..500: mol_type = other DNA
atgtatataagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaagatctcaccgggaagcctgtctgtgtcgtcagggattttccagcccccttgcctgagtcaactgtcttttccggctgtcaaatggggatacccaccatctctgtccccattggagacccacagtctaatcggaacccccagctttcttctgcctggaagaaggagttgaaggagctagcttcccgggtggccttcctcaccaaggaggatgaactgaagaagaaagaggatactaccagtcttaattggaattg

SEQ ID NO: 5981 - DNA, 533 bp, synthetic construct
  misc_feature 1..533: note = Synthetic polypeptide
  source 1..533: mol_type = other DNA
atggctacagatgttcaattggctgattatccactgatgagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaagatctcaccgggaagcctgtctgtgtcgtcagggattttccagcccccttgcctgagtcaactgtcttttccggctgtcaaatggggatacccaccatctctgtccccattggagacccacagtctaatcggaacccccagctttcttctgaagcctggaagaaggagttgaaggagctagcttcccgggtggccttcctcaccaaggaggatgaactgaagaagaaagaggatactaccagtcttaattggaattg

SEQ ID NO: 5982 - DNA, 1038 bp, synthetic construct
  misc_feature 1..1038: note = Synthetic polypeptide
  source 1..1038: mol_type = other DNA
atgctgctcctgttcctcctcttcgagggtctctgctgtcctggggaaaatacagcagaccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctgggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattc

SEQ ID NO: 5983 - DNA, 1335 bp, synthetic construct
  misc_feature 1..1335: note = Synthetic polypeptide
  source 1..1335: mol_type = other DNA
atgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaataccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctgggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattc

SEQ ID NO: 5984 - DNA, 768 bp, synthetic construct
  misc_feature 1..768: note = Synthetic polypeptide
  source 1..768: mol_type = other DNA
atgctgctcctgttcctcctcttcgagggtctctgctgtcctggggaaaatacagcagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctgggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattc

SEQ ID NO: 5985 - DNA, 1065 bp, synthetic construct
  misc_feature 1..1065: note = Synthetic polypeptide
  source 1..1065: mol_type = other DNA
atgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaattgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctgggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattc

SEQ ID NO: 5986 - DNA, 603 bp, synthetic construct
  misc_feature 1..603: note = Synthetic polypeptide
  source 1..603: mol_type = other DNA
atgctgctcctgttcctcctcttcgagggtctctgctgtcctggggaaaatacagcagtgaagccagaggcctggctgtcctgtggccccagtcctggccctggccgtctgcagcttgtgtgccatgtctcaggattctacccaaagcccgtgtgggtgatgtggatgcggggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctgggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattc

SEQ ID NO: 5987 - DNA, 732 bp, synthetic construct
  misc_feature 1..732: note = Synthetic polypeptide
  source 1..732: mol_type = other DNA
atgctgctcctgttcctcctcttcgagggtctctgctgtcctggggaaaatacagcagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctgggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattc

SEQ ID NO: 5988 - DNA, 1134 bp, synthetic construct
  misc_feature 1..1134: note = Synthetic polypeptide
  source 1..1134: mol_type = other DNA
atgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaataccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctgggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattc

SEQ ID NO: 5989 - DNA, 864 bp, synthetic construct
  misc_feature 1..864: note = Synthetic polypeptide
  source 1..864: mol_type = other DNA
atgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaattgaagccagaggcctggctgtcctgtggccccagtcctggccctggccgtctgcagcttgtgtgccatgtctcaggattctacccaaagcccgtgtgggtgatgtggatgcggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctgggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattc

SEQ ID NO: 5990 - DNA, 1029 bp, synthetic construct
  misc_feature 1..1029: note = Synthetic polypeptide
  source 1..1029: mol_type = other DNA
atgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaattgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctgggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattc

SEQ ID NO: 5991 - DNA, 567 bp, synthetic construct
  misc_feature 1..567: note = Synthetic polypeptide
  source 1..567: mol_type = other DNA
atgctgctcctgttcctcctcttcgagggtctctgctgtcctggggaaaatacagcagtgaagccagaggcctggctgtcctgtggccccagtcctggccctggccgtctgcagcttgtgtgccatgtctcaggattctacccaaagcccgtgtgggtgatgtggatgcggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctgggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattc

SEQ ID NO: 5992 - DNA, 1299 bp, synthetic construct
  misc_feature 1..1299: note = Synthetic polypeptide
  source 1..1299: mol_type = other DNA
atgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaataccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctgggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattc

SEQ ID NO: 5993 - DNA, 649 bp, synthetic construct; identical to SEQ ID NO: 1872
  misc_feature 1..649: note = Synthetic polypeptide
  source 1..649: mol_type = other DNA

SEQ ID NO: 5994 - DNA, 559 bp, synthetic construct; identical to SEQ ID NO: 1873
  misc_feature 1..559: note = Synthetic polypeptide
  source 1..559: mol_type = other DNA

SEQ ID NO: 5995 - DNA, 109 bp, synthetic construct; identical to SEQ ID NO: 1874
  misc_feature 1..109: note = Synthetic polypeptide
  source 1..109: mol_type = other DNA

SEQ ID NO: 5996 - DNA, 1110 bp, synthetic construct; identical to SEQ ID NO: 5164
  misc_feature 1..1110: note = Synthetic polypeptide
  source 1..1110: mol_type = other DNA

SEQ ID NO: 5997 - DNA, 1026 bp, synthetic construct; identical to SEQ ID NO: 5165
  misc_feature 1..1026: note = Synthetic polypeptide
  source 1..1026: mol_type = other DNA

SEQ ID NO: 5998 - DNA, 822 bp, synthetic construct; identical to SEQ ID NO: 5166
  misc_feature 1..822: note = Synthetic polypeptide
  source 1..822: mol_type = other DNA

SEQ ID NO: 5999 - DNA, 757 bp, synthetic construct; identical to SEQ ID NO: 1859
  misc_feature 1..757: note = Synthetic polypeptide
  source 1..757: mol_type = other DNA

SEQ ID NO: 6000 - DNA, 817 bp, synthetic construct; identical to SEQ ID NO: 1860
  misc_feature 1..817: note = Synthetic polypeptide
  source 1..817: mol_type = other DNA

SEQ ID NO: 6001 - DNA, 459 bp, synthetic construct
  misc_feature 1..459: note = Synthetic polypeptide
  source 1..459: mol_type = other DNA
atggccggtacatggctgctacttctcctggcccttgggtgtccagccctacccacaggtgtgggcggcacaccctttccttctctggccccaccaatcatgctgctggtggatggaaagcagcagatggtggtggtctgcctggtccttgatgttgcaccccctggccttgacagccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacagcaggagtacacagcccatgcatctgtcagggattatctcaattttgtcatctttcaaatgggaatgtttgttaactaagtgccctgacttccaaagaatgctgcgaaga

SEQ ID NO: 6002 - DNA, 384 bp, synthetic construct
  misc_feature 1..384: note = Synthetic polypeptide
  source 1..384: mol_type = other DNA
atggccggtacatggctgctacttctcctggcccttgggtgtccagccctacccacaggtcctgtttccttcccttcctcaccagaggctgccacaacaggccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacagcaggagtacacagcccatgcatctgtcagggattatctcaattttgtcatctttcaaatgggaatgtttgttaactaagtgccctgacttccaaagaatgctgcgaaga

SEQ ID NO: 6003 - DNA, 890 bp, synthetic construct
  misc_feature 1..890: note = Synthetic polypeptide
  source 1..890: mol_type = other DNA
atggaagctgttgccaagtttgatttcactgcttcaggtgaggatgaactgagctttcacactggagatgttttgaagattttaagtaaccaagaggagtggtttaaggcggagcttgggagccaggaaggatatgtgcccaagaatttcatagacatccagtttcccaagcatgaggatgacgttcaacacttcaaggtcatgcgagacaacaagggtaattactttctgtggactgagaagtttccatccctaaataagctggtagactactacaggacaaattccatctccagacagaagcagatcttccttagagacagaacccgagaagaccagggtcaccggggcaacagcctggaccggaggtcccagggaggcccacacctcagtggggctgtgggagaagaaatccgaccttcgatgaaccggaagctgtcggatcaccccccgacccttcccctgcagcagcaccagcaccagccacagcctccgcaatatgccccagcgccccagcagctgcagcagcccccacagcagcgatatctgcagcaccaccatttccaccaggaacgccgaggaggcagccttgacataaatgatgggcattgtggcaccggcttgggcagtgaaatgaatgcggccctcatgcatcggagacacacagacccagtgcagctccaggcggcaggggcaatgtggagaggtggaaaagtcacaagctttgagtcagaaacacgtgggctgcagtccagactctgctacttacgctatcagcctggacaagtttcttgaccactctgagctgatctagagaactggggataatagcactgagttgtcatgagaagtaaacaaaattataggaactacttggtaagaacctagca

SEQ ID NO: 6004 - DNA, 1010 bp, synthetic construct
  misc_feature 1..1010: note = Synthetic polypeptide
  source 1..1010: mol_type = other DNA
atggaagctgttgccaagtttgatttcactgcttcaggtgaggatgaactgagctttcacactggagatgttttgaagattttaagtaaccaagaggagtggtttaaggcggagcttgggagccaggaaggatatgtgcccaagaatttcatagacatccagtttcccaaatggtttcacgaaggcctctctcgacaccaggcagagaacttactcatgggcaaggaggttggcttcttcatcatccgggccagccagagctccccaggggacttctccatctctgtcaggcatgaggatgacgttcaacacttcaaggtcatgcgagacaacaagggtaattactttctgtggactgagaagtttccatccctaaataagctggtagactactacaggacaaattccatctccagacagaagcagatcttccttagagacagaacccgagaagaccagggtcaccggggcaacagcctggaccggaggtcccagggaggcccacacctcagtggggctgtgggagaagaaatccgaccttcgatgaaccggaagctgtcggatcaccccccgacccttcccctgcagcagcaccagcaccagccacagcctccgcaatatgccccagcgccccagcagctgcagcagcccccacagcagcgatatctgcagcaccaccatttccaccaggaacgccgaggaggcagccttgacataaatgatgggcattgtggcaccggcttgggcagtgaaatgaatgcggccctcatgcatcggagacacacagacccagtgcagctccaggcggcaggggcaatgtggagaggtggaaaagtcacaagctttgagtcagaaacacgtgggctgcagtccagactctgctacttacgctatcagcctggacaagtttcttgaccactctgagctgatctagagaactggggataatagcactgagttgtcatgagaagtaaacaaaattataggaactacttggtaagaacctagca

SEQ ID NO: 6005 - DNA, 812 bp, synthetic construct
  misc_feature 1..812: note = Synthetic polypeptide
  source 1..812: mol_type = other DNA
atgcttgaatttgtctcccttcttgccagaaaggattctaataactcggtgtcaaagccaagacataaactcaaccccttctcttccaaaaggcatgaggatgacgttcaacacttcaaggtcatgcgagacaacaagggtaattactttctgtggactgagaagtttccatccctaaataagctggtagactactacaggacaaattccatctccagacagaagcagatcttccttagagacagaacccgagaagaccagggtcaccggggcaacagcctggaccggaggtcccagggaggcccacacctcagtggggctgtgggagaagaaatccgaccttcgatgaaccggaagctgtcggatcaccccccgacccttcccctgcagcagcaccagcaccagccacagcctccgcaatatgccccagcgccccagcagctgcagcagcccccacagcagcgatatctgcagcaccaccatttccaccaggaacgccgaggaggcagccttgacataaatgatgggcattgtggcaccggcttgggcagtgaaatgaatgcggccctcatgcatcggagacacacagacccagtgcagctccaggcggcaggggcaatgtggagaggtggaaaagtcacaagctttgagtcagaaacacgtgggctgcagtccagactctgctacttacgctatcagcctggacaagtttcttgaccactctgagctgatctagagaactggggataatagcactgagttgtcatgagaagtaaacaaaattataggaactacttggtaagaacctagca

SEQ ID NO: 6006 - DNA, 794 bp, synthetic construct
  misc_feature 1..794: note = Synthetic polypeptide
  source 1..794: mol_type = other DNA
atgggcaaggaggttggcttcttcatcatccgggccagccagagctccccaggggacttctccatctctgtcaggcatgaggatgacgttcaacacttcaaggtcatgcgagacaacaagggtaattactttctgtggactgagaagtttccatccctaaataagctggtagactactacaggacaaattccatctccagacagaagcagatcttccttagagacagaacccgagaagaccagggtcaccggggcaacagcctggaccggaggtcccagggaggcccacacctcagtggggctgtgggagaagaaatccgaccttcgatgaaccggaagctgtcggatcaccccccgacccttcccctgcagcagcaccagcaccagccacagcctccgcaatatgccccagcgccccagcagctgcagcagcccccacagcagcgatatctgcagcaccaccatttccaccaggaacgccgaggaggcagccttgacataaatgatgggcattgtggcaccggcttgggcagtgaaatgaatgcggccctcatgcatcggagacacacagacccagtgcagctccaggcggcaggggcaatgtggagaggtggaaaagtcacaagctttgagtcagaaacacgtgggctgcagtccagactctgctacttacgctatcagcctggacaagtttcttgaccactctgagctgatctagagaactggggataatagcactgagttgtcatgagaagtaaacaaaattataggaactacttggtaagaacctagca

SEQ ID NO: 6007 - DNA, 671 bp, synthetic construct
  misc_feature 1..671: note = Synthetic polypeptide
  source 1..671: mol_type = other DNA
atggtttcacgaaggcctctctcgacaccaggcagagaacttactcatgggcaaggaggttggcttcttcatcatccgggccagccagagctccccaggggacttctccatctctgtcagggtcaccggggcaacagcctggaccggaggtcccagggaggcccacacctcagtggggctgtgggagaagaaatccgaccttcgatgaaccggaagctgtcggatcaccccccgacccttcccctgcagcagcaccagcaccagccacagcctccgcaatatgccccagcgccccagcagctgcagcagcccccacagcagcgatatctgcagcaccaccatttccaccaggaacgccgaggaggcagccttgacataaatgatgggcattgtggcaccggcttgggcagtgaaatgaatgcggccctcatgcatcggagacacacagacccagtgcagctccaggcggcaggggcaatgtggagaggtggaaaagtcacaagctttgagtcagaaacacgtgggctgcagtccagactctgctacttacgctatcagcctggacaagtttcttgaccactctgagctgatctagagaactggggataatagcactgagttgtcatgagaagtaaacaaaattataggaactacttggtaagaacctagca

SEQ ID NO: 6008 - DNA, 822 bp, synthetic construct; identical to SEQ ID NO: 119
  misc_feature 1..822: note = Synthetic polypeptide
  source 1..822: mol_type = other DNA

SEQ ID NO: 6009 - DNA, 2409 bp, synthetic construct; identical to SEQ ID NO: 1481
  misc_feature 1..2409: note = Synthetic polypeptide
  source 1..2409: mol_type = other DNA

SEQ ID NO: 6010 - DNA, 124 bp, synthetic construct
  misc_feature 1..124: note = Synthetic polypeptide
  source 1..124: mol_type = other DNA
atggaacatagcacgtttctctctggcctggtactggctacccttctctcgcaagttttaaaatggaaagtcccatgtccgaggaaccccttcaacactaagcaaactgggtccaatggtcacc

SEQ ID NO: 6011 - DNA, 168 bp, synthetic construct
  misc_feature 1..168: note = Synthetic polypeptide
  source 1..168: mol_type = other DNA
atgggacagctgatcgccaagttaatgagcatcttcgggaaccaggagcacacggtcatcatcgtgggactggacaatgaaggaaagaccaccattctctaccggtttgtggtctacagaccagtcacacaggcatcacctgaaagcttattaggaatgcaaaaccat

SEQ ID NO: 6012 - DNA, 317 bp, synthetic construct; identical to SEQ ID NO: 995
  misc_feature 1..317: note = Synthetic polypeptide
  source 1..317: mol_type = other DNA

SEQ ID NO: 6013 - DNA, 562 bp, synthetic construct
  misc_feature 1..562: note = Synthetic polypeptide
  source 1..562: mol_type = other DNA
atgaaacatctgtggttcttccttctcctggtggcagctcccagatgggtcctgtcccaggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagacacagtgaggggaggcagagaagaggccatgtggagacgtaatgcactagaaggtggcccagtgcaagccaggaagaagcctcaccaagaaccaaccctgccagaacattgatcttcaacattcagactgcagaattttaagaaaatcaatatttgttgtttaagccacccactcctgttgtcttcttatgaagatccagacagactaatac

SEQ ID NO: 6014 - DNA, 228 bp, synthetic construct
  misc_feature 1..228: note = Synthetic polypeptide
  source 1..228: mol_type = other DNA
atggccggtacatggctgctacttctcctggcccttgggtgtccagccctacccacagccgggcgctgtggcgggcacctgtagtcccagctactcaggaggctgaggcaggagaatggcatgaacccaggaggtggaacttgcagtgagctgagatcgcgccactgcactctagcctgggcaacagagcaaaattccatctcaaaaaaaaaaaaaagaaagaaagaa

SEQ ID NO: 6015 - DNA, 1490 bp, synthetic construct; identical to SEQ ID NO: 1677
  misc_feature 1..1490: note = Synthetic polypeptide
  source 1..1490: mol_type = other DNA

SEQ ID NO: 6016 - DNA, 1451 bp, synthetic construct; identical to SEQ ID NO: 1678
  misc_feature 1..1451: note = Synthetic polypeptide
  source 1..1451: mol_type = other DNA

SEQ ID NO: 6017 - DNA, 926 bp, synthetic construct; identical to SEQ ID NO: 1679
  misc_feature 1..926: note = Synthetic polypeptide
  source 1..926: mol_type = other DNA

SEQ ID NO: 6018 - DNA, 1451 bp, synthetic construct; identical to SEQ ID NO: 1680
  misc_feature 1..1451: note = Synthetic polypeptide
  source 1..1451: mol_type = other DNA

SEQ ID NO: 6019 - DNA, 1033 bp, synthetic construct; identical to SEQ ID NO: 1822
  misc_feature 1..1033: note = Synthetic polypeptide
  source 1..1033: mol_type = other DNA

SEQ ID NO: 6020 - DNA, 1075 bp, synthetic construct; identical to SEQ ID NO: 1823
  misc_feature 1..1075: note = Synthetic polypeptide
  source 1..1075: mol_type = other DNA

SEQ ID NO: 6021 - DNA, 1081 bp, synthetic construct; identical to SEQ ID NO: 986
  misc_feature 1..1081: note = Synthetic polypeptide
  source 1..1081: mol_type = other DNA

SEQ ID NO: 6022 - DNA, 1054 bp, synthetic construct; identical to SEQ ID NO: 987
  misc_feature 1..1054: note = Synthetic polypeptide
  source 1..1054: mol_type = other DNA

SEQ ID NO: 6023 - DNA, 2107 bp, synthetic construct; identical to SEQ ID NO: 5673
  misc_feature 1..2107: note = Synthetic polypeptide
  source 1..2107: mol_type = other DNA

SEQ ID NO: 6024 - DNA, 1221 bp, synthetic construct; identical to SEQ ID NO: 122
  misc_feature 1..1221: note = Synthetic polypeptide
  source 1..1221: mol_type = other DNA

SEQ ID NO: 6025 - DNA, 2564 bp, synthetic construct; identical to SEQ ID NO: 3321
  misc_feature 1..2564: note = Synthetic polypeptide
  source 1..2564: mol_type = other DNA

SEQ ID NO: 6026 - DNA, 3077 bp, synthetic construct; identical to SEQ ID NO: 3322
  misc_feature 1..3077: note = Synthetic polypeptide
  source 1..3077: mol_type = other DNA

SEQ ID NO: 6027 - DNA, 3038 bp, synthetic construct; identical to SEQ ID NO: 3323
  misc_feature 1..3038: note = Synthetic polypeptide
  source 1..3038: mol_type = other DNA

SEQ ID NO: 6028 - DNA, 652 bp, synthetic construct
  misc_feature 1..652: note = Synthetic polypeptide
  source 1..652: mol_type = other DNA
atgaacctgtggctcctggcctgcctggtggccggcttcctgggagcctgggcccccgctgtccacacccaaggtgtctttgaggactgctgcctggcctaccactaccccattgggtgggctgtgctccggcgcgcctggacttaccggatccaggaggtgagcgggagctgcaatctgcctgctgcgatattctacctccccaagagacacaggaaggtgtgtgggaaccccaaaagcagggaggtgcagagagccatgaagctcctggatgctcgaaataaggtttttgcaaagctccaccacaacacgcagaccttccaaggccctcatgctgtaaagaagttgagttctggaaactccaagttatcatcgtccaagtttagcaatcccatcagcagcagcaagaggaacgcttgagcccagcctgggcaacatggtgaaatcccatctctacaaaaaagtacaaaaattagctgggtgtggtggcacccgcctgtagtcctagctacttgggatgctgaggtgggaggatcacttaggcccaagacgcagaggtagcaatgagccgtgatctcgccacggcactctagcctgagcaacagaaccaggccctgtcttctaaaaaaaaaaaaaaaaaaaaagaaagaaa

SEQ ID NO: 6029 - DNA, 655 bp, synthetic construct
  misc_feature 1..655: note = Synthetic polypeptide
  source 1..655: mol_type = other DNA
atgaacctgtggctcctggcctgcctggtggccggcttcctgggagcctgggcccccgctgtccacacccaaggtgtctttgaggactgctgcctggcctaccactaccccattgggtgggctgtgctccggcgcgcctggacttaccggatccaggaggtgagcgggagctgcaatctgcctgctgcgatattctacctccccaagagacacaggaaggtgtgtgggaaccccaaaagcagggaggtgcagagagccatgaagctcctggatgctcgaaataaggtttttgcaaagctccaccacaacacgcagaccttccaagcaggccctcatgctgtaaagaagttgagttctggaaactccaagttatcatcgtccaagtttagcaatcccatcagcagcagcaagaggaacgcttgagcccagcctgggcaacatggtgaaatcccatctctacaaaaaagtacaaaaattagctgggtgtggtggcacccgcctgtagtcctagctacttgggatgctgaggtgggaggatcacttaggcccaagacgcagaggtagcaatgagccgtgatctcgccacggcactctagcctgagcaacagaaccaggccctgtcttctaaaaaaaaaaaaaaaaaaaaagaaagaaa

SEQ ID NO: 6030 - DNA, 1598 bp, synthetic construct; identical to SEQ ID NO: 1699
  misc_feature 1..1598: note = Synthetic polypeptide
  source 1..1598: mol_type = other DNA

SEQ ID NO: 6031 - DNA, 814 bp, synthetic construct
  misc_feature 1..814: note = Synthetic polypeptide
  source 1..814: mol_type = other DNA
atggccgtctggcttgcccagtggctgggccctctgctcttggtttccctctggggactcttggctccagcctcccttcttaggcgcctgggtgagcacattcagcagtttcaggagagctctgcccagggcctgggcctgagcctggggccaggtgctgcagccctcccaaaagtggggtggctggagcaactgctggaccccttcaacgtgtccgacagacgatccttcctacagcgttactgggtgaatgaccaacattgggttggccaggatggacccatattcctgcatctagggggtgagggcagccttgggcctggctcagtgatgagaggccatcccgcagccttggccccagcctggggcgccctggtgataagcctggaacacagattttatggcctgagtatacctgctggaggcctggaaatggcccagctccgcttcttgtccagccgccttgcgtggaaatcagagtaattctgttagagcataaaccaggacatgatcctccctggcttaagtccctcagacatcttctgtattgcttcagaagtaaagcaattttgactgtatttgacttcagagtaaagtcaaagcttttacagtcgccatggagtccagtgggttttggcctctagttaactctgacctatactctctcactttcactgggctccagctacattgaagtcctcactgtcctccagacttacacgcacattcctgccttgagcctttgaactcatccctctgcatggcgtggccttcccctagatgtttttatgcctctcaccccagcctccttcag

SEQ ID NO: 6032 - DNA, 488 bp, synthetic construct
  misc_feature 1..488: note = Synthetic polypeptide
  source 1..488: mol_type = other DNA
agtgatgagaggccatcccgcagccttggccccagcctggggcgccctggtgataagcctggaacacagattttatggcctgagtatacctgctggaggcctggaaatggcccagctccgcttcttgtccagccgccttgcgtggaaatcagagtaattctgttagagcataaaccaggacatgatcctccctggcttaagtccctcagacatcttctgtattgcttcagaagtaaagcaattttgactgtatttgacttcagagtaaagtcaaagcttttacagtcgccatggagtccagtgggttttggcctctagttaactctgacctatactctctcactttcactgggctccagctacattgaagtcctcactgtcctccagacttacacgcacattcctgccttgagcctttgaactcatccctctgcatggcgtggccttcccctagatgtttttatgcctctcaccccagcctccttcag

SEQ ID NO: 6033 - DNA, 681 bp, synthetic construct; identical to SEQ ID NO: 1642
  misc_feature 1..681: note = Synthetic polypeptide
  source 1..681: mol_type = other DNA

SEQ ID NO: 6034 - DNA, 534 bp, synthetic construct; identical to SEQ ID NO: 1643
  misc_feature 1..534: note = Synthetic polypeptide
  source 1..534: mol_type = other DNA

SEQ ID NO: 6035 - DNA, 270 bp, synthetic construct; identical to SEQ ID NO: 1644
  misc_feature 1..270: note = Synthetic polypeptide
  source 1..270: mol_type = other DNA

SEQ ID NO: 6036 - DNA, 596 bp, synthetic construct; identical to SEQ ID NO: 1645
  misc_feature 1..596: note = Synthetic polypeptide
  source 1..596: mol_type = other DNA

SEQ ID NO: 6037 - DNA, 344 bp, synthetic construct; identical to SEQ ID NO: 1869
  misc_feature 1..344: note = Synthetic polypeptide
  source 1..344: mol_type = other DNA

SEQ ID NO: 6038 - DNA, 1420 bp, synthetic construct; identical to SEQ ID NO: 924
  misc_feature 1..1420: note = Synthetic polypeptide
  source 1..1420: mol_type = other DNA

SEQ ID NO: 6039 - DNA, 1336 bp, synthetic construct; identical to SEQ ID NO: 925
  misc_feature 1..1336: note = Synthetic polypeptide
  source 1..1336: mol_type = other DNA

SEQ ID NO: 6040 - DNA, 1069 bp, synthetic construct; identical to SEQ ID NO: 926
  misc_feature 1..1069: note = Synthetic polypeptide
  source 1..1069: mol_type = other DNA

SEQ ID NO: 6041 - DNA, 1345 bp, synthetic construct; identical to SEQ ID NO: 927
  misc_feature 1..1345: note = Synthetic polypeptide
  source 1..1345: mol_type = other DNA

SEQ ID NO: 6042 - DNA, 652 bp, synthetic construct
  misc_feature 1..652: note = Synthetic polypeptide
  source 1..652: mol_type = other DNA
atggctacagatgttcaattggctgattatccactgatgagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaagatctcaccgggaagcctgtctgtgtcgtcagggattttccagcccccttgcctgagtcaactgtcttttccggctgtcaaatggggatacccaccatctctgtccccattggagacccacagtctaatcggaacccccagctttcttctgaagcctggaagaaggagttgaaggagctagcttcccgggtggccttcctcaccaaggaggatgaactgaagaagaaagagagtggacaggcagaggcccggcttctcattcctgctcacaactaactcactgcagcactcaggacaactcagctaagctgtctgggtctctgttttcttatctttaaaatggggggaaggatactaccagtcttaattggaattg

SEQ ID NO: 6043 - DNA, 619 bp, synthetic construct
  misc_feature 1..619: note = Synthetic polypeptide
  source 1..619: mol_type = other DNA
atgtatataagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaagatctcaccgggaagcctgtctgtgtcgtcagggattttccagcccccttgcctgagtcaactgtcttttccggctgtcaaatggggatacccaccatctctgtccccattggagacccacagtctaatcggaacccccagctttcttctgcctggaagaaggagttgaaggagctagcttcccgggtggccttcctcaccaaggaggatgaactgaagaagaaagagagtggacaggcagaggcccggcttctcattcctgctcacaactaactcactgcagcactcaggacaactcagctaagctgtctgggtctctgttttcttatctttaaaatggggggaaggatactaccagtcttaattggaattg

SEQ ID NO: 6044 - DNA, 316 bp, synthetic construct; identical to SEQ ID NO: 1815
  misc_feature 1..316: note = Synthetic polypeptide
  source 1..316: mol_type = other DNA

SEQ ID NO: 6045 - DNA, 464 bp, synthetic construct; identical to SEQ ID NO: 1863
  misc_feature 1..464: note = Synthetic polypeptide
  source 1..464: mol_type = other DNA

SEQ ID NO: 6046 - DNA, 909 bp, synthetic construct; identical to SEQ ID NO: 1830
  misc_feature 1..909: note = Synthetic polypeptide
  source 1..909: mol_type = other DNA

SEQ ID NO: 6047 - DNA, 963 bp, synthetic construct; identical to SEQ ID NO: 1831
  misc_feature 1..963: note = Synthetic polypeptide
  source 1..963: mol_type = other DNA

SEQ ID NO: 6048 - DNA, 876 bp, synthetic construct; identical to SEQ ID NO: 1832
  misc_feature 1..876: note = Synthetic polypeptide
  source 1..876: mol_type = other DNA

SEQ ID NO: 6049 - DNA, 2466 bp, synthetic construct; identical to SEQ ID NO: 1682
  misc_feature 1..2466: note = Synthetic polypeptide
  source 1..2466: mol_type = other DNA

SEQ ID NO: 6050 - DNA, 1806 bp, synthetic construct; identical to SEQ ID NO: 1683
  misc_feature 1..1806: note = Synthetic polypeptide
  source 1..1806: mol_type = other DNA

SEQ ID NO: 6051 - DNA, 2412 bp, synthetic construct; identical to SEQ ID NO: 1684
  misc_feature 1..2412: note = Synthetic polypeptide
  source 1..2412: mol_type = other DNA

SEQ ID NO: 6052 - DNA, 2211 bp, synthetic construct; identical to SEQ ID NO: 1685
  misc_feature 1..2211: note = Synthetic polypeptide
  source 1..2211: mol_type = other DNA

SEQ ID NO: 6053 - DNA, 364 bp, synthetic construct; identical to SEQ ID NO: 1686
  misc_feature 1..364: note = Synthetic polypeptide
  source 1..364: mol_type = other DNA

SEQ ID NO: 6054 - DNA, 1731 bp, synthetic construct; identical to SEQ ID NO: 989
  misc_feature 1..1731: note = Synthetic polypeptide
  source 1..1731: mol_type = other DNA

SEQ ID NO: 6055 - DNA, 2262 bp, synthetic construct; identical to SEQ ID NO: 990
  misc_feature 1..2262: note = Synthetic polypeptide
  source 1..2262: mol_type = other DNA

SEQ ID NO: 6056 - DNA, 2253 bp, synthetic construct; identical to SEQ ID NO: 991
  misc_feature 1..2253: note = Synthetic polypeptide
  source 1..2253: mol_type = other DNA

SEQ ID NO: 6057 - DNA, 105 bp, synthetic construct
  misc_feature 1..105: note = Synthetic polypeptide
  source 1..105: mol_type = other DNA
atgaacgtgatgggttttaacacagaccgcttagcatggactagaaatgacctgtggtattgcctggcatagaaggatactcagtgaacatttgttgagtgaatg

SEQ ID NO: 6058 - DNA, 734 bp, synthetic construct; identical to SEQ ID NO: 930
  misc_feature 1..734: note = Synthetic polypeptide
  source 1..734: mol_type = other DNA

SEQ ID NO: 6059 - DNA, 678 bp, synthetic construct
  misc_feature 1..678: note = Synthetic polypeptide
  source 1..678: mol_type = other DNA
atggcggcggccgttccacagcgggcgtggaccgtggagcagctgcgcagtgagcagctgcccaagaaggacattatcaagtttctgcaggaacacggttcagattcgtttcttgcagaacataaattattaggaaacattaaaaatgtggccaagacagctaacaaggaccacttggttacagcctataaccatctttttgaaactaagcgttttaagggtactgaaagtataagtaaagtgtctgagcaagtaaaaaatgtgaagcttaatgaagataaacccaaagaaaccaagtctgaagagaccctggatgagggtccaccaaaatatactaaatctgttctgaaaaagggagataaaaccaactttcccaaaaagggagatgttgttcactgctggtatacaggaacactacaagatgggactgtttttgatactaatattcaaacaagtgcaaagaagaagaaaaatgccaagcctttaagttttaaggtcggagtaggcaaagttatcagaggactgggcatgcctgtaatcccaactactagggaggctgaggcaggagaatcggttaaacccgggaggcagaggctgcagtgagccaagatcacgctattgcactccagccagggcaacaagagcgaaactccatctcaaaagaaaaaaagaaaaaaa

SEQ ID NO: 6060 - DNA, 1823 bp, synthetic construct
  misc_feature 1..1823: note = Synthetic polypeptide
  source 1..1823: mol_type = other DNA
atggcagaagatgatccatatttgggaaggcctgaacaaatgtttcatttggatccttctttgactcatacaatatttaatccagaagtatttcaaccacagatggcactgccaacagcagatggcccataccttcaaatattagagcaacctaaacagagaggatttcgtttccgttatgtatgtgaaggcccatcccatggtggactacctggtgcctctagtgaaaagaacaagaagtcttaccctcaggtcaaaatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcggcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgctggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagaggtcttccaacactgcaaagggagagttagctggagacacagcgaggccctttgatgggcatatgcagaa

SEQ ID NO: 6061 - DNA, 1820 bp, synthetic construct
  misc_feature 1..1820: note = Synthetic polypeptide
  source 1..1820: mol_type = other DNA
atggcagaagatgatccatatttgggaaggcctgaacaaatgtttcatttggatccttctttgactcatacaatatttaatccagaagtatttcaaccacagatggcactgccaacagatggcccataccttcaaatattagagcaacctaaacagagaggatttcgtttccgttatgtatgtgaaggcccatcccatggtggactacctggtgcctctagtgaaaagaacaagaagtcttaccctcaggtcaaaatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcggcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgctggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagaggtcttccaacactgcaaagggagagttagctggagacacagcgaggccctttgatgggcatatgcagaa

SEQ ID NO: 6062 - DNA, 1280 bp, synthetic construct
  misc_feature 1..1280: note = Synthetic polypeptide
  source 1..1280: mol_type = other DNA
atgaatggactgtgctgtatggccctagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgctggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagaggtcttccaacactgcaaagggagagttagctggagacacagcgaggccctttgatgggcatatgcagaa

SEQ ID NO: 6063 - DNA, 1689 bp, synthetic construct; identical to SEQ ID NO: 964
  misc_feature 1..1689: note = Synthetic polypeptide
  source 1..1689: mol_type = other DNA

SEQ ID NO: 6064 - DNA, 1671 bp, synthetic construct; identical to SEQ ID NO: 965
  misc_feature 1..1671: note = Synthetic polypeptide
  source 1..1671: mol_type = other DNA

SEQ ID NO: 6065 - DNA, 650 bp, synthetic construct; identical to SEQ ID NO: 966
  misc_feature 1..650: note = Synthetic polypeptide
  source 1..650: mol_type = other DNA

SEQ ID NO: 6066 - DNA, 105 bp, synthetic construct; identical to SEQ ID NO: 6057
  misc_feature 1..105: note = Synthetic polypeptide
  source 1..105: mol_type = other DNA

SEQ ID NO: 6067 - DNA, 105 bp, synthetic construct; identical to SEQ ID NO: 6057
  misc_feature 1..105: note = Synthetic polypeptide
  source 1..105: mol_type = other DNA

SEQ ID NO: 6068 - DNA, 303 bp, synthetic construct
  misc_feature 1..303: note = Synthetic polypeptide
  source 1..303: mol_type = other DNA
atggctacagatgttcaattggctgattatccactgatgagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaaggatactaccagtcttaattggaattg

SEQ ID NO: 6069 - DNA, 273 bp, synthetic construct
  misc_feature 1..273: note = Synthetic polypeptide
  source 1..273: mol_type = other DNA
atgtatataagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaaggatactaccagtcttaattggaattg

SEQ ID NO: 6070 - DNA, 860 bp, synthetic construct; identical to SEQ ID NO: 2285
  misc_feature 1..860: note = Synthetic polypeptide
  source 1..860: mol_type = other DNA

SEQ ID NO: 6071 - DNA, 1823 bp, synthetic construct; identical to SEQ ID NO: 2286
  misc_feature 1..1823: note = Synthetic polypeptide
  source 1..1823: mol_type = other DNA

SEQ ID NO: 6072 - DNA, 1796 bp, synthetic construct; identical to SEQ ID NO: 2287
  misc_feature 1..1796: note = Synthetic polypeptide
  source 1..1796: mol_type = other DNA

SEQ ID NO: 6073 - DNA, 904 bp, synthetic construct; identical to SEQ ID NO: 5647
  misc_feature 1..904: note = Synthetic polypeptide
  source 1..904: mol_type = other DNA

SEQ ID NO: 6074 - DNA, 1072 bp, synthetic construct; identical to SEQ ID NO: 5648
  misc_feature 1..1072: note = Synthetic polypeptide
  source 1..1072: mol_type = other DNA

SEQ ID NO: 6075 - DNA, 1587 bp, synthetic construct; identical to SEQ ID NO: 3984
  misc_feature 1..1587: note = Synthetic polypeptide
  source 1..1587: mol_type = other DNA

SEQ ID NO: 6076 - DNA, 117 bp, synthetic construct; identical to SEQ ID NO: 928
  misc_feature 1..117: note = Synthetic polypeptide
  source 1..117: mol_type = other DNA

SEQ ID NO: 6077 - DNA, 51 bp, synthetic construct; identical to SEQ ID NO: 929
  misc_feature 1..51: note = Synthetic polypeptide
  source 1..51: mol_type = other DNA

SEQ ID NO: 6078 - DNA, 1105 bp, synthetic construct
  misc_feature 1..1105: note = Synthetic polypeptide
  source 1..1105: mol_type = other DNA
atgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtgctgcggtgggaagattgctggagcccaggagttcgaggctgcggtgagccatgatcacaccactgtactccagcaacacagcgaaaccctgtctc

SEQ ID NO: 6079 - DNA, 1021 bp, synthetic construct
  misc_feature 1..1021: note = Synthetic polypeptide
  source 1..1021: mol_type = other DNA
atgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtgctgcggtgggaagattgctggagcccaggagttcgaggctgcggtgagccatgatcacaccactgtactccagcaacacagcgaaaccctgtctc

SEQ ID NO: 6080 - DNA, 817 bp, synthetic construct
  misc_feature 1..817: note = Synthetic polypeptide
  source 1..817: mol_type = other DNA
atggcagaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtgctgcggtgggaagattgctggagcccaggagttcgaggctgcggtgagccatgatcacaccactgtactccagcaacacagcgaaaccctgtctc

SEQ ID NO: 6081 - DNA, 105 bp, synthetic construct; identical to SEQ ID NO: 6057
  misc_feature 1..105: note = Synthetic polypeptide
  source 1..105: mol_type = other DNA

SEQ ID NO: 6082 - DNA, 346 bp, synthetic construct
  misc_feature 1..346: note = Synthetic polypeptide
  source 1..346: mol_type = other DNA
atggtttggcagcagaagaccaaagcagttgtcatgctgaaccgcattgtggagaaagaatcggttggagggcttacacctataatcccagcactttgggaggctgaggcaggagggtcacttgagcccaggaattcaaaaccagcctcgacaacaaagtgagaccctgcctctacaaaaaatacaaaaagtagccaggtgtggtggcacgcacctggagtcccagctggggttgggggattgcttgagcccagaagattgaggctgaagtgagccaagttcaccccagtgcactccagcctgggctactacagagcaagacactgtctcttaaaaaaaaaaaaaa

SEQ ID NO: 6083 - DNA, 643 bp, synthetic construct
  misc_feature 1..643: note = Synthetic polypeptide
  source 1..643: mol_type = other DNA
atgcccaccaccatcgagcgggagttcgaagagttggatactcagcgtcgctggcagccgctgtacttggaaattcgaaatgagtcccatgactatcctcatagagtggccaagtttccagaaaacagaaatcgaaacagatacagagatgtaagcccatatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcggttggagggcttacacctataatcccagcactttgggaggctgaggcaggagggtcacttgagcccaggaattcaaaaccagcctcgacaacaaagtgagaccctgcctctacaaaaaatacaaaaagtagccaggtgtggtggcacgcacctggagtcccagctggggttgggggattgcttgagcccagaagattgaggctgaagtgagccaagttcaccccagtgcactccagcctgggctactacagagcaagacactgtctcttaaaaaaaaaaaaaa

SEQ ID NO: 6084 - DNA, 416 bp, synthetic construct
  misc_feature 1..416: note = Synthetic polypeptide
  source 1..416: mol_type = other DNA
agaagaggcacaaaggagttacatcttaacacagggtccacttcctaacacatgctgccatttctggcttatggtttggcagcagaagaccaaagcagttgtcatgctgaaccgcattgtggagaaagaatcggttggagggcttacacctataatcccagcactttgggaggctgaggcaggagggtcacttgagcccaggaattcaaaaccagcctcgacaacaaagtgagaccctgcctctacaaaaaatacaaaaagtagccaggtgtggtggcacgcacctggagtcccagctggggttgggggattgcttgagcccagaagattgaggctgaagtgagccaagttcaccccagtgcactccagcctgggctactacagagcaagacactgtctcttaaaaaaaaaaaaaa

SEQ ID NO: 6085 - DNA, 556 bp, synthetic construct
  misc_feature 1..556: note = Synthetic polypeptide
  source 1..556: mol_type = other DNA
atgtatggaaaggatggtaaaggcaccaactggatggatcagggagacatggaatgcagaatgcaggaaatagatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcggttggagggcttacacctataatcccagcactttgggaggctgaggcaggagggtcacttgagcccaggaattcaaaaccagcctcgacaacaaagtgagaccctgcctctacaaaaaatacaaaaagtagccaggtgtggtggcacgcacctggagtcccagctggggttgggggattgcttgagcccagaagattgaggctgaagtgagccaagttcaccccagtgcactccagcctgggctactacagagcaagacactgtctcttaaaaaaaaaaaaaa

SEQ ID NO: 6086 - DNA, 1213 bp, synthetic construct; identical to SEQ ID NO: 1093
  misc_feature 1..1213: note = Synthetic polypeptide
  source 1..1213: mol_type = other DNA

SEQ ID NO: 6087 - DNA, 616 bp, synthetic construct; identical to SEQ ID NO: 1094
  misc_feature 1..616: note = Synthetic polypeptide
  source 1..616: mol_type = other DNA

SEQ ID NO: 6088 - DNA, 868 bp, synthetic construct; identical to SEQ ID NO: 1095
  misc_feature 1..868: note = Synthetic polypeptide
  source 1..868: mol_type = other DNA

SEQ ID NO: 6089 - DNA, 528 bp, synthetic construct; identical to SEQ ID NO: 1280
  misc_feature 1..528: note = Synthetic polypeptide
  source 1..528: mol_type = other DNA

SEQ ID NO: 6090 - DNA, 438 bp, synthetic construct; identical to SEQ ID NO: 1281
  misc_feature 1..438: note = Synthetic polypeptide
  source 1..438: mol_type = other DNA

SEQ ID NO: 6091 - DNA, 453 bp, synthetic construct
  misc_feature 1..453: note = Synthetic polypeptide
  source 1..453: mol_type = other DNA
atggctacagatgttcaattggctgattatccactgatgagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaagatctcaccgggaagcctgtctgtgtcgtcagggattttccagcccccttgcctgagtcaactgtcttttccggctgtcaaatggggatacccaccatctctgtccccattggagacccacagtctaatcggaacccccagctttcttctggatactaccagtcttaattggaattg

SEQ ID NO: 6092 - DNA, 423 bp, synthetic construct
  misc_feature 1..423: note = Synthetic polypeptide
  source 1..423: mol_type = other DNA
atgtatataagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaagatctcaccgggaagcctgtctgtgtcgtcagggattttccagcccccttgcctgagtcaactgtcttttccggctgtcaaatggggatacccaccatctctgtccccattggagacccacagtctaatcggaacccccagctttcttctggatactaccagtcttaattggaattg

SEQ ID NO: 6093 - DNA, 1537 bp, synthetic construct
  misc_feature 1..1537: note = Synthetic polypeptide
  source 1..1537: mol_type = other DNA
atggatccaccacgagcgtcccacttgagccctcggaagaagagaccccggcagacgggtgccttgatggcctcctctcctcaagacatcaaatttcaagatttggtcgtcttcattttggagaagaaaatgggaaccacccgcagagcgttcctcatggagctggcccgcaggaaagggttcagggttgaaaatgagctcagtgattctgtcacccacatcgtagcagagaacaactcgggttcggatgttctggagtggcttcaagcacagaaagtacaagtcagctcacaaccagagctcctcgatgtctcctggctgatcgaatgcataagagcagggaaaccggtggaaatgacaggaaaacaccagcttgttgtgagaagagactattcagatagcaccaacccaggccccccgaagactccaccaattgctgtacaaaagatctcccagtatgcgtgtcagagaagaaccactttaaacaactgtaaccagatattcacggatgcctttgatatactggctgaaaactgtgagtttagagaaaatgaagactcctgtgtgacatttatgagagcagcttctgtattgaaatctctgccattcacaatcatcagtatgaaggacacagaaggaattccctgcctggggtccaaggtgaagggtatcatagaggagattattgaagatggagaaagttctgaagttaaagctgtgttaaatgatgaacgatatcaatccttcaaactctttacttctgtatttggagtggggctgaagacttctgagaagtggttcaggatgggtttcagaactctgagtaaagtaaggtcggacaaaagcctgaaatttacacgaatgcagaaagcaggatttctgtattatgaagaccttgtcagctgtgtgaccagggcagaagcagaggccgtcagtgtgctggttaaagaggctgtctgggcatttcttccggatgctttcgtcaccatgacaggagggttccggaggggtaagaagatggggcatgatgtagattttttaattaccagcccaggatcaacagaggatgaagagcaacttttacagaaagtgatgaacttatgggaaaagaagggattacttttatattatgaccttgtggagtcaacatttgaaaagctcaggttgcctagcaggaaggttgatgctttggatcattttcaaaagtgctttctgattttcaaattgcctcgtcaaagagtggacagtgaccagtccagctggcaggaaggaaagacctggaaggccatccgtgtggatttagttctgtgcccctacgagcgtcgtgcctttgccctgttgggatggactggctcccggtttgagagagacctccggcgctatgccacacatgagcggaagatgattctggataaccatgctttatatgacaagaccaagaactcctttgagacagaaaactgttgaatttagaagtattttgtgttttctccttggagtagaaggtaagacccccaaagggcatggtctaacaaga

SEQ ID NO: 6094 - DNA, 1540 bp, synthetic construct
  misc_feature 1..1540: note = Synthetic polypeptide
  source 1..1540: mol_type = other DNA
atggatccaccacgagcgtcccacttgagccctcggaagaagagaccccggcagacgggtgccttgatggcctcctctcctcaagacatcaaatttcaagatttggtcgtcttcattttggagaagaaaatgggaaccacccgcagagcgttcctcatggagctggcccgcaggaaagggttcagggttgaaaatgagctcagtgattctgtcacccacatcgtagcagagaacaactcgggttcggatgttctggagtggcttcaagcacagaaagtacaagtcagctcacaaccagagctcctcgatgtctcctggctgatcgaatgcataagagcagggaaaccggtggaaatgacaggaaaacaccagcttgttgtgagaagagactattcagatagcaccaacccaggccccccgaagactccaccaattgctgtacaaaagatctcccagtatgcgtgtcagagaagaaccactttaaacaactgtaaccagatattcacggatgcctttgatatactggctgaaaactgtgagtttagagaaaatgaagactcctgtgtgacatttatgagagcagcttctgtattgaaatctctgccattcacaatcatcagtatgaaggacacagaaggaattccctgcctggggtccaaggtgaagggtatcatagaggagattattgaagatggagaaagttctgaagttaaagctgtgttaaatgatgaacgatatcaatccttcaaactctttacttctgtatttggagtggggctgaagacttctgagaagtggttcaggatgggtttcagaactctgagtaaagtaaggtcggacaaaagcctgaaatttacacgaatgcagaaagcaggatttctgtattatgaagaccttgtcagctgtgtgaccagggcagaagcagaggccgtcagtgtgctggttaaagaggctgtctgggcatttcttccggatgctttcgtcaccatgacaggagggttccggaggggtaagaagatggggcatgatgtagattttttaattaccagcccaggatcaacagaggatgaagagcaacttttacagaaagtgatgaacttatgggaaaagaagggattacttttatattatgaccttgtggagtcaacatttgaaaagctcaggttgcctagcaggaaggttgatgctttggatcattttcaaaagtgctttctgattttcaaattgcctcgtcaaagagtggacagtgaccagtccagctggcaggaaggaaagacctggaaggccatccgtgtggatttagttctgtgcccctacgagcgtcgtgcctttgccctgttgggatggactggctcccggcagtttgagagagacctccggcgctatgccacacatgagcggaagatgattctggataaccatgctttatatgacaagaccaagaactcctttgagacagaaaactgttgaatttagaagtattttgtgttttctccttggagtagaaggtaagacccccaaagggcatggtctaacaaga

SEQ ID NO: 6095 - DNA, 597 bp, synthetic construct
  misc_feature 1..597: note = Synthetic polypeptide
  source 1..597: mol_type = other DNA
atggctacagatgttcaattggctgattatccactgatgagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaagatctcaccgggaagcctgtctgtgtcgtcagggattttccagcccccttgcctgagtcaactgtcttttccggctgtcaaatggggatacccaccatctctgtccccattggagacccacagtctaatcggaacccccagctttcttctgaagcctggaagaaggagttgaaggagctagcttcccgggtggccttcctcaccaaggaggatgaactgaagaagaaagagcactcaggacaactcagctaagctgtctgggtctctgttttcttatctttaaaatggggggaaggatactaccagtcttaattggaattg

SEQ ID NO: 6096 - DNA, 564 bp, synthetic construct
  misc_feature 1..564: note = Synthetic polypeptide
  source 1..564: mol_type = other DNA
atgtatataagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaagatctcaccgggaagcctgtctgtgtcgtcagggattttccagcccccttgcctgagtcaactgtcttttccggctgtcaaatggggatacccaccatctctgtccccattggagacccacagtctaatcggaacccccagctttcttctgcctggaagaaggagttgaaggagctagcttcccgggtggccttcctcaccaaggaggatgaactgaagaagaaagagcactcaggacaactcagctaagctgtctgggtctctgttttcttatctttaaaatggggggaaggatactaccagtcttaattggaattg

SEQ ID NO: 6097 - DNA, 138 bp, synthetic construct
  misc_feature 1..138: note = Synthetic polypeptide
  source 1..138: mol_type = other DNA
atggccggtacatggctgctacttctcctggcccttgggtgtccagccctacccacagggattatctcaattttgtcatctttcaaatgggaatgtttgttaactaagtgccctgacttccaaagaatgctgcgaaga

SEQ ID NO: 6098 - DNA, 700 bp, synthetic construct
  misc_feature 1..700: note = Synthetic polypeptide
  source 1..700: mol_type = other DNA
catctttggttcagtgaccaacataccagcaaaggatgcagcaccagtggagaaaatagacaccatgctggtcttggaaggcagtggaaacctggtgctatacacaggagtggttcgggtgggaaaggtttttattcctggactgccagctccctctctgacgatgtccaacacaatgcctcggcccagtactccactagatggcgttagtactccaaagcctcttagtaaactccttggatcattggacgaggttgttctgttgtccccagttccagaactgagggattcttcaaaacttcatgattctctctataatgaggattgtactttccaacagcttggaacttacattcattctatcagagatcctgtccataacagagtcaccctggaactgagtaatggctccatggttaggatcactattcctgaaattgccacctctgagttagtacaaacgtgtttgcaagcaattaagtttatcctgccaaaagaaatagcagttcagatgcttgtcaagtggtacaatgtccacagtgctccaggaggacccagttatcactcagagtggaatttatttgtgacttgtctcatgaacatgatgggttataacacagaccgcttagcatggactagaaatgacctgtggtattgcctggcatagaaggatactcagtgaacatttgttgagtgaatg

SEQ ID NO: 6099 - DNA, 2097 bp, synthetic construct
  misc_feature 1..2097: note = Synthetic polypeptide
  source 1..2097: mol_type = other DNA
atgtcgaacttctatgaagaaaggacaacgatgattgcagcaagggatttgcaggaatttgttccttttggtcgagaccactgcaagcaccaccctaatgctttgaaccttcaacttcgccagctgcagccagcttctgaattatggtcttctgatggtgctgctggcttggtgggatcccttcaggaggttacaatccacgagaaacagaaggaaagctggcagttaaggaaaggagtaagtgaaattggagaagatgtggactatgatgaggaactctatgttgctggaaatatggtgatatggagcaaaggaagtaaaagccaggcattggcagtttataaagcatttacagttgacagtcctgttcagcaggcattgtggtgtgacttcattatatcacaggataagtctgaaaaggcctacagtagcaatgaagtagaaaaatgcatatgtatattgcaaagctcatgtattaacatgcatagcatagaaggaaaggattacatagcttcattaccatttcaggttgcaaatgtttggcccactaaatatggattgctgtttgaacgaagcgcttcttcacatgaagtacctccaggttcacccagagaacctttacctactatgttcagcatgctgcacccactagatgaaataactccacttgtttgtaaatctggaagtctttttggttcatcacgggtgcaatatgttgtagatcatgcaatgaaaattgttttcctcaatactgacccctctattgtaatgacttatgatgctgttcaaaatgtgcattctgtgtggactctccggagagtcaaatcagaggaagagaatgttgttttaaagttctctgaacaggggggaaccccacagaatgtggccactagcagctccctcacagcacatctcagaagcctctccaaaggagattcccctgtgacttcacctttccagaattactcctccattcacagccagagtcgctcaacctcatcacccagtctacattctcgctcaccttctatttccaacatggcagctctaagtcgtgctcattctcctgcgttaggagtgcactctttttcaggggtgcaaaggttcaacatttcaagccataatcagtctccaaagagacatagtatttctcattctccaaatagtaattctaatggctcctttcttgcaccagaaacggagccaattgttcctgaactgtgtattgaccatttgtggacagaaacgattactaatataagagagaaaaattcacaagcctcaaaagtgtttattacatctgacctatgtgggcaaaagttcctgtgctttttagtagagtcccagctccagttacgctgtgtaaagtttcaagagagtaatgataaaacccagctcatctttggttcagtgaccaacataccagcaaaggatgcagcaccagtggagaaaatagacaccatgctggtcttggaaggcagtggaaacctggtgctatacacaggagtggttcgggtgggaaaggtttttattcctggactgccagctccctctctgacgatgtccaacacaatgcctcggcccagtactccactagatggcgttagtactccaaagcctcttagtaaactccttggatcattggacgaggttgttctgttgtccccagttccagaactgagggattcttcaaaacttcatgattctctctataatgaggattgtactttccaacagcttggaacttacattcattctatcagagatcctgtccataacagagtcaccctggaactgagtaatggctccatggttaggatcactattcctgaaattgccacctctgagttagtacaaacgtgtttgcaagcaattaagtttatcctgccaaaagaaatagcagttcagatgcttgtcaagtggtacaatgtccacagtgctccaggaggacccagttatcactcagagtggaatttatttgtgacttgtctcatgaacatgatgggttataacacagaccgcttagcatggactagaaatgacctgtggtattgcctggcatagaaggatactcagtgaacatttgttgagtgaatg

SEQ ID NO: 6100 - DNA, 836 bp, synthetic construct
  misc_feature 1..836: note = Synthetic polypeptide
  source 1..836: mol_type = other DNA
atgtcgaacttctatgaagaaaggacaacgatgattgcagcaagggatttgcaggaatttgttccttttggtcgagaccactgcaagcaccaccctaatgctttgaaccttcaacttcgccagctgcagccagcttctgaattatggtcttctgatggtgctgctggcttggtgggatcccttcaggaggttacaatccacgagaaacagaaggaaagctggcagttaaggaaaggagtaagtgaaattggagaagatgtggactatgatgaggaactctatgttgctggaaatatggtgatatggagcaaaggaagtaaaagccaggcattggcagtttataaagcatttacagttgacagtcctgttcagcaggaagacatgcagttcatctccatttgatgaaggaaaacttgtacttagagaagaatgctagctaataagtgtaaaaggaattgtagaattagaatatcaccattttgtaacctccagtgcaataattgattccaacaaggattgtaaatggatactaacactgttggttgaaagaatattaccatggcaccaacacatcaccctgtggattacctggtaaatgtgaaggaacaaatgtacctctactttggagttatttgtcagtctccacctcaatcaagtgattgagtttagcataattagtagtgacatgaaggagtattatgtgcttctagctataatacagaatgaagtacatgatgtcatctaagttttcttcccaaaaatatgaatatttagacctaacttcctatttataggaaatataggcaatagagaattatattttaaaataccatgag

SEQ ID NO: 6101 - DNA, 346 bp, synthetic construct
  misc_feature 1..346: note = Synthetic polypeptide
  source 1..346: mol_type = other DNA
atggctacagatgttcaattggctgattatccactgatgagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaaggatccccccgtgggtgaggcggtcgctggtctaggtggttacaatgccctcccagctctgataatctat

SEQ ID NO: 6102 - DNA, 316 bp, synthetic construct
  misc_feature 1..316: note = Synthetic polypeptide
  source 1..316: mol_type = other DNA
atgtatataagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaaggatccccccgtgggtgaggcggtcgctggtctaggtggttacaatgccctcccagctctgataatctat

SEQ ID NO: 6103 - DNA, 258 bp, synthetic construct; identical to SEQ ID NO: 265
  misc_feature 1..258: note = Synthetic polypeptide
  source 1..258: mol_type = other DNA

SEQ ID NO: 6104 - DNA, 243 bp, synthetic construct; identical to SEQ ID NO: 267
  misc_feature 1..243: note = Synthetic polypeptide
  source 1..243: mol_type = other DNA

SEQ ID NO: 6105 - DNA, 324 bp, synthetic construct; identical to SEQ ID NO: 268
  misc_feature 1..324: note = Synthetic polypeptide
  source 1..324: mol_type = other DNA

SEQ ID NO: 6106 - DNA, 1313 bp, synthetic construct; identical to SEQ ID NO: 182
  misc_feature 1..1313: note = Synthetic polypeptide
  source 1..1313: mol_type = other DNA

SEQ ID NO: 6107 - DNA, 1253 bp, synthetic construct; identical to SEQ ID NO: 183
  misc_feature 1..1253: note = Synthetic polypeptide
  source 1..1253: mol_type = other DNA

SEQ ID NO: 6108 - DNA, 1259 bp, synthetic construct; identical to SEQ ID NO: 185
  misc_feature 1..1259: note = Synthetic polypeptide
  source 1..1259: mol_type = other DNA

SEQ ID NO: 6109 - DNA, 1250 bp, synthetic construct; identical to SEQ ID NO: 187
  misc_feature 1..1250: note = Synthetic polypeptide
  source 1..1250: mol_type = other DNA

SEQ ID NO: 6110 - DNA, 2557 bp, synthetic construct; identical to SEQ ID NO: 1524
  misc_feature 1..2557: note = Synthetic polypeptide
  source 1..2557: mol_type = other DNA

SEQ ID NO: 6111 - DNA, 2428 bp, synthetic construct; identical to SEQ ID NO: 1525
  misc_feature 1..2428: note = Synthetic polypeptide
  source 1..2428: mol_type = other DNA

SEQ ID NO: 6112 - DNA, 478 bp, synthetic construct
  misc_feature 1..478: note = Synthetic polypeptide
  source 1..478: mol_type = other DNA
atggccgtctggcttgcccagtggctgggccctctgctcttggtttccctctggggactcttggctccagcctcccttcttaggcgcctgggtgagcacattcagcagtttcaggagagctctgcccagggcctgggcctgagcctggggccaggtgctgcagccctcccaaaagtggggtggctggagcaactgctggaccccttcaacgtgtccgacagacgatccttcctacagattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctggttgtttcaaggactaaaggaggtaatatttgtagcattctaagaataatgcaggtctacagtaagtattccataaacctcttgctattgttattatt

SEQ ID NO: 6113 - DNA, 1249 bp, synthetic construct
  misc_feature 1..1249: note = Synthetic polypeptide
  source 1..1249: mol_type = other DNA
atggccgtctggcttgcccagtggctgggccctctgctcttggtttccctctggggactcttggctccagcctcccttcttaggcgcctgggtgagcacattcagcagtttcaggagagctctgcccagggcctgggcctgagcctggggccaggtgctgcagccctcccaaaagtggggtggctggagcaactgctggaccccttcaacgtgtccgacagacgatccttcctacagcgttactgggtgaatgaccaacattgggttggccaggatggacccatattcctgcatctagggggtgagggcagccttgggcctggctcagtgatgagaggccatcccgcagccttggccccagcctggggcgccctggtgataagcctggaacacagattttatggcctgagtatacctgctggaggcctggaaatggcccagctccgcttcttgtccagccgccttgcgctggctgatgtggtctctgcccgcctggcactttcccgcctctttaacatctcctcctccagcccctggatctgcttcggaggctcctatgccggctccttggccgcctgggcccggctgaagttcccccatctcattttcgcgtcggtcgcctcctccgccccggtgcgggccgtgctggatttctccgagtataatgacgtggtatcccgaagcctaatgagcaccgcgatcggcgggtccctggagtgccgggcggcggtgtccgtcgccttcgctgaagtggagcggcggctgcgctcgggtggggcggctcaagcagcattgcggacggagctgagcgcttgcgggcccctgggccgcgctgaaaaccaggcggagctgttgggggcgctgcaggcactggtgggaggtgtagtgcagtatgatgggcagacgggagcgccgctaagcgtgcgacagctctgcggacttctcctcgggggcgggggcaaccgcagccactccacgccctactgcgggcttcgtcgggcggtgcagattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctggttgtttcaaggactaaaggaggtaatatttgtagcattctaagaataatgcaggtctacagtaagtattccataaacctcttgctattgttattatt

SEQ ID NO: 6114 - DNA, 584 bp, synthetic construct
  misc_feature 1..584: note = Synthetic polypeptide
  source 1..584: mol_type = other DNA
agtgatgagaggccatcccgcagccttggccccagcctggggcgccctggtgataagcctggaacacagattttatggcctgagtatacctgctggaggcctggaaatggcccagctccgcttcttgtccagccgccttgcgctggctgatgtggtctctgcccgcctggcactttcccgcctctttaacatctcctcctccagcccctggatctgcttcggaggctcctatgccggctccttggccgcctgggcccggctgaagttcccccatctcattttcgcgtcggtcgcctcctccgccccggtgcgggccgtgctggatttctccgagtataatgacattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctggttgtttcaaggactaaaggaggtaatatttgtagcattctaagaataatgcaggtctacagtaagtattccataaacctcttgctattgttattatt

SEQ ID NO: 6115 - DNA, 506 bp, synthetic construct
  misc_feature 1..506: note = Synthetic polypeptide
  source 1..506: mol_type = other DNA
agtgatgagaggccatcccgcagccttggccccagcctggggcgccctggtgataagcctggaacacagattttatggcctgagtatacctgctggaggcctggaaatggcccagctccgcttcttgtccagccgccttgcgctggctgatgtggtctctgcccgcctggcactttcccgcctctttaacatctcctcctccagcccctggatctgcttcggaggctcctatgccggctccttggccgcctgggcccggctgaagattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctggttgtttcaaggactaaaggaggtaatatttgtagcattctaagaataatgcaggtctacagtaagtattccataaacctcttgctattgttattatt

SEQ ID NO: 6116 - DNA, 1032 bp, synthetic construct; identical to SEQ ID NO: 1790
  misc_feature 1..1032: note = Synthetic polypeptide
  source 1..1032: mol_type = other DNA

SEQ ID NO: 6117 - DNA, 289 bp, synthetic construct; identical to SEQ ID NO: 1791
  misc_feature 1..289: note = Synthetic polypeptide
  source 1..289: mol_type = other DNA

SEQ ID NO: 6118 - DNA, 1314 bp, synthetic construct; identical to SEQ ID NO: 1792
  misc_feature 1..1314: note = Synthetic polypeptide
  source 1..1314: mol_type = other DNA

SEQ ID NO: 6119 - DNA, 620 bp, synthetic construct; identical to SEQ ID NO: 1793
  misc_feature 1..620: note = Synthetic polypeptide
  source 1..620: mol_type = other DNA

SEQ ID NO: 6120 - DNA, 559 bp, synthetic construct; identical to SEQ ID NO: 1701
  misc_feature 1..559: note = Synthetic polypeptide
  source 1..559: mol_type = other DNA

SEQ ID NO: 6121 - DNA, 1398 bp, synthetic construct; identical to SEQ ID NO: 948
  misc_feature 1..1398: note = Synthetic polypeptide
  source 1..1398: mol_type = other DNA

SEQ ID NO: 6122 - DNA, 1302 bp, synthetic construct; identical to SEQ ID NO: 949
  misc_feature 1..1302: note = Synthetic polypeptide
  source 1..1302: mol_type = other DNA

SEQ ID NO: 6123 - DNA, 1081 bp, synthetic construct; identical to SEQ ID NO: 986
  misc_feature 1..1081: note = Synthetic polypeptide
  source 1..1081: mol_type = other DNA

SEQ ID NO: 6124 - DNA, 1054 bp, synthetic construct; identical to SEQ ID NO: 987
  misc_feature 1..1054: note = Synthetic polypeptide
  source 1..1054: mol_type = other DNA

SEQ ID NO: 6125 - DNA, 2409 bp, synthetic construct; identical to SEQ ID NO: 1481
  misc_feature 1..2409: note = Synthetic polypeptide
  source 1..2409: mol_type = other DNA

SEQ ID NO: 6126 - DNA, 1834 bp, synthetic construct; identical to SEQ ID NO: 133
  misc_feature 1..1834: note = Synthetic polypeptide
  source 1..1834: mol_type = other DNA

SEQ ID NO: 6127 - DNA, 1765 bp, synthetic construct; identical to SEQ ID NO: 135
  misc_feature 1..1765: note = Synthetic polypeptide
  source 1..1765: mol_type = other DNA

SEQ ID NO: 6128 - DNA, 1221 bp, synthetic construct; identical to SEQ ID NO: 122
  misc_feature 1..1221: note = Synthetic polypeptide
  source 1..1221: mol_type = other DNA

SEQ ID NO: 6129 - DNA, 860 bp, synthetic construct; identical to SEQ ID NO: 2285
  misc_feature 1..860: note = Synthetic polypeptide
  source 1..860: mol_type = other DNA

SEQ ID NO: 6130 - DNA, 1823 bp, synthetic construct; identical to SEQ ID NO: 2286
  misc_feature 1..1823: note = Synthetic polypeptide
  source 1..1823: mol_type = other DNA

SEQ ID NO: 6131 - DNA, 1796 bp, synthetic construct; identical to SEQ ID NO: 2287
  misc_feature 1..1796: note = Synthetic polypeptide
  source 1..1796: mol_type = other DNA

SEQ ID NO: 6132 - DNA, 1063 bp, synthetic construct; identical to SEQ ID NO: 2221
  misc_feature 1..1063: note = Synthetic polypeptide
  source 1..1063: mol_type = other DNA

SEQ ID NO: 6133 - DNA, 640 bp, synthetic construct; identical to SEQ ID NO: 1700
  misc_feature 1..640: note = Synthetic polypeptide
  source 1..640: mol_type = other DNA

SEQ ID NO: 6134 - DNA, 1146 bp, synthetic construct; identical to SEQ ID NO: 988
  misc_feature 1..1146: note = Synthetic polypeptide
  source 1..1146: mol_type = other DNA

SEQ ID NO: 6135 - DNA, 117 bp, synthetic construct; identical to SEQ ID NO: 928
  misc_feature 1..117: note = Synthetic polypeptide
  source 1..117: mol_type = other DNA

SEQ ID NO: 6136 - DNA, 51 bp, synthetic construct; identical to SEQ ID NO: 929
  misc_feature 1..51: note = Synthetic polypeptide
  source 1..51: mol_type = other DNA

SEQ ID NO: 6137 - DNA, 1743 bp, synthetic construct; identical to SEQ ID NO: 1253
  misc_feature 1..1743: note = Synthetic polypeptide
  source 1..1743: mol_type = other DNA

SEQ ID NO: 6138 - DNA, 1518 bp, synthetic construct; identical to SEQ ID NO: 1254
  misc_feature 1..1518: note = Synthetic polypeptide
  source 1..1518: mol_type = other DNA

SEQ ID NO: 6139 - DNA, 1767 bp, synthetic construct; identical to SEQ ID NO: 1255
  misc_feature 1..1767: note = Synthetic polypeptide
  source 1..1767: mol_type = other DNA

SEQ ID NO: 6140 - DNA, 2362 bp, synthetic construct; identical to SEQ ID NO: 1664
  misc_feature 1..2362: note = Synthetic polypeptide
  source 1..2362: mol_type = other DNA

SEQ ID NO: 6141 - DNA, 2113 bp, synthetic construct; identical to SEQ ID NO: 1665
  misc_feature 1..2113: note = Synthetic polypeptide
  source 1..2113: mol_type = other DNA

SEQ ID NO: 6142 - DNA, 1399 bp, synthetic construct; identical to SEQ ID NO: 1666
  misc_feature 1..1399: note = Synthetic polypeptide
  source 1..1399: mol_type = other DNA

SEQ ID NO: 6143 - DNA, 2080 bp, synthetic construct; identical to SEQ ID NO: 1667
  misc_feature 1..2080: note = Synthetic polypeptide
  source 1..2080: mol_type = other DNA

SEQ ID NO: 6144 - DNA, 317 bp, synthetic construct; identical to SEQ ID NO: 995
  misc_feature 1..317: note = Synthetic polypeptide
  source 1..317: mol_type = other DNA

SEQ ID NO: 6145 - DNA, 696 bp, synthetic construct; identical to SEQ ID NO: 2305
  misc_feature 1..696: note = Synthetic polypeptide
  source 1..696: mol_type = other DNA

SEQ ID NO: 6146 - DNA, 1379 bp, synthetic construct; identical to SEQ ID NO: 985
  misc_feature 1..1379: note = Synthetic polypeptide
  source 1..1379: mol_type = other DNA

SEQ ID NO: 6147 - DNA, 1052 bp, synthetic construct; identical to SEQ ID NO: 247
  misc_feature 1..1052: note = Synthetic polypeptide
  source 1..1052: mol_type = other DNA

SEQ ID NO: 6148 - DNA, 327 bp, synthetic construct; identical to SEQ ID NO: 246
  misc_feature 1..327: note = Synthetic polypeptide
  source 1..327: mol_type = other DNA

SEQ ID NO: 6149 - DNA, 2161 bp, synthetic construct; identical to SEQ ID NO: 288
  misc_feature 1..2161: note = Synthetic polypeptide
  source 1..2161: mol_type = other DNA

SEQ ID NO: 6150 - DNA, 2140 bp, synthetic construct; identical to SEQ ID NO: 289
  misc_feature 1..2140: note = Synthetic polypeptide
  source 1..2140: mol_type = other DNA

SEQ ID NO: 6151 - DNA, 529 bp, synthetic construct; identical to SEQ ID NO: 287
  misc_feature 1..529: note = Synthetic polypeptide
  source 1..529: mol_type = other DNA

SEQ ID NO: 6152 - DNA, 577 bp, synthetic construct; identical to SEQ ID NO: 1112
  misc_feature 1..577: note = Synthetic polypeptide
  source 1..577: mol_type = other DNA

SEQ ID NO: 6153 - DNA, 252 bp, synthetic construct; identical to SEQ ID NO: 1113
  misc_feature 1..252: note = Synthetic polypeptide
  source 1..252: mol_type = other DNA

SEQ ID NO: 6154 - DNA, 980 bp, synthetic construct; identical to SEQ ID NO: 139
  misc_feature 1..980: note = Synthetic polypeptide
  source 1..980: mol_type = other DNA

SEQ ID NO: 6155 - DNA, 1256 bp, synthetic construct; identical to SEQ ID NO: 140
  misc_feature 1..1256: note = Synthetic polypeptide
  source 1..1256: mol_type = other DNA

SEQ ID NO: 6156 - DNA, 1277 bp, synthetic construct; identical to SEQ ID NO: 142
  misc_feature 1..1277: note = Synthetic polypeptide
  source 1..1277: mol_type = other DNA

SEQ ID NO: 6157 - DNA, 2160 bp, synthetic construct; identical to SEQ ID NO: 4209
  misc_feature 1..2160: note = Synthetic polypeptide
  source 1..2160: mol_type = other DNA

SEQ ID NO: 6158 - DNA, 2625 bp, synthetic construct; identical to SEQ ID NO: 4210
  misc_feature 1..2625: note = Synthetic polypeptide
  source 1..2625: mol_type = other DNA

SEQ ID NO: 6159 - DNA, 2849 bp, synthetic construct; identical to SEQ ID NO: 1326
  misc_feature 1..2849: note = Synthetic polypeptide
  source 1..2849: mol_type = other DNA

SEQ ID NO: 6160 - DNA, 1925 bp, synthetic construct; identical to SEQ ID NO: 1327
  misc_feature 1..1925: note = Synthetic polypeptide
  source 1..1925: mol_type = other DNA

SEQ ID NO: 6161 - DNA, 2729 bp, synthetic construct; identical to SEQ ID NO: 1328
  misc_feature 1..2729: note = Synthetic polypeptide
  source 1..2729: mol_type = other DNA

SEQ ID NO: 6162 - DNA, 2549 bp, synthetic construct; identical to SEQ ID NO: 1329
  misc_feature 1..2549: note = Synthetic polypeptide
  source 1..2549: mol_type = other DNA

SEQ ID NO: 6163 - DNA, 810 bp, synthetic construct; identical to SEQ ID NO: 4445
  misc_feature 1..810: note = Synthetic polypeptide
  source 1..810: mol_type = other DNA

SEQ ID NO: 6164 - DNA, 372 bp, synthetic construct; identical to SEQ ID NO: 1188
  misc_feature 1..372: note = Synthetic polypeptide
  source 1..372: mol_type = other DNA

SEQ ID NO: 6165 - DNA, 392 bp, synthetic construct; identical to SEQ ID NO: 410
  misc_feature 1..392: note = Synthetic polypeptide
  source 1..392: mol_type = other DNA

SEQ ID NO: 6166 - DNA, 1094 bp, synthetic construct; identical to SEQ ID NO: 153
  misc_feature 1..1094: note = Synthetic polypeptide
  source 1..1094: mol_type = other DNA

SEQ ID NO: 6167 - DNA, 609 bp, synthetic construct; identical to SEQ ID NO: 249
  misc_feature 1..609: note = Synthetic polypeptide
  source 1..609: mol_type = other DNA

SEQ ID NO: 6168 - DNA, 738 bp, synthetic construct; identical to SEQ ID NO: 250
  misc_feature 1..738: note = Synthetic polypeptide
  source 1..738: mol_type = other DNA

SEQ ID NO: 6169 - DNA, 537 bp, synthetic construct; identical to SEQ ID NO: 251
  misc_feature 1..537: note = Synthetic polypeptide
  source 1..537: mol_type = other DNA

SEQ ID NO: 6170 - DNA, 684 bp, synthetic construct; identical to SEQ ID NO: 253
  misc_feature 1..684: note = Synthetic polypeptide
  source 1..684: mol_type = other DNA

SEQ ID NO: 6171 - DNA, 285 bp, synthetic construct; identical to SEQ ID NO: 255
  misc_feature 1..285: note = Synthetic polypeptide
  source 1..285: mol_type = other DNA

SEQ ID NO: 6172 - DNA, 552 bp, synthetic construct; identical to SEQ ID NO: 254
  misc_feature 1..552: note = Synthetic polypeptide
  source 1..552: mol_type = other DNA

SEQ ID NO: 6173 - DNA, 1062 bp, synthetic construct
  misc_feature 1..1062: note = Synthetic polypeptide
  source 1..1062: mol_type = other DNA
atggcggtggacatcacgctgctattccgggccagcgtcaagaccgtgaagacgcggaacaaggcgctgggagtggcggtgggcggcggggtcgatggcagccgggacgagctgttccgccggagcccccggcccaagggcgacttctccagccgggcccgcgaagtgatttctcacattggcaaactgagagattttcttctggaacacaggaaagattatattaatgcttatagccataccatgtctgaatatgggaggatgacagacacagaacgagaccagatagaccaggatgcccagatattcatgaggacctgttcagaagcaattcagcaactacgaacagaagctcacaaggagatacattcccagcaagtgaaggagcacaggaccgctgttttggatttcattgaagattacttgaaaagagtatgtaaactttactcagaacagagagccatccgagttaaaagagtggtggataagaaaagattatctaagctggaaccagaaccaaatacaaagacaagagaatccacatcttctgagaaagtttcacagagtccttcaaaagactctgaagaaaaccctgccactgaagaacgtccagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttgatgaagtgaggcaaatcgaagggagagtggttgagatttccagactccaagagatattcacggaaaaggttttgcaacaggaagctgagattgacagcattcaccagttagttgtgggggcaactgaaaatatcaaggaaggcaacgaagacataagagaggccattaaaaacaacgctggcttccgcgtgtggatcctcttcttcctcgtgatgtgctccttctccttgctcttcctcgactggtccctcacctataaaatgcggccaatgagtcacaccaccgtgttgctgaggactcaagtcaatgca

SEQ ID NO: 6174 - DNA, 281 bp, synthetic construct; identical to SEQ ID NO: 1368
  misc_feature 1..281: note = Synthetic polypeptide
  source 1..281: mol_type = other DNA

SEQ ID NO: 6175 - DNA, 128 bp, synthetic construct; identical to SEQ ID NO: 144
  misc_feature 1..128: note = Synthetic polypeptide
  source 1..128: mol_type = other DNA

SEQ ID NO: 6176 - DNA, 884 bp, synthetic construct; identical to SEQ ID NO: 2542
  misc_feature 1..884: note = Synthetic polypeptide
  source 1..884: mol_type = other DNA

SEQ ID NO: 6177 - DNA, 312 bp, synthetic construct; identical to SEQ ID NO: 1728
  misc_feature 1..312: note = Synthetic polypeptide
  source 1..312: mol_type = other DNA

SEQ ID NO: 6178 - DNA, 299 bp, synthetic construct; identical to SEQ ID NO: 1033
  misc_feature 1..299: note = Synthetic polypeptide
  source 1..299: mol_type = other DNA

SEQ ID NO: 6179 - DNA, 191 bp, synthetic construct; identical to SEQ ID NO: 1034
  misc_feature 1..191: note = Synthetic polypeptide
  source 1..191: mol_type = other DNA

SEQ ID NO: 6180 - DNA, 128 bp, synthetic construct; identical to SEQ ID NO: 1082
  misc_feature 1..128: note = Synthetic polypeptide
  source 1..128: mol_type = other DNA

SEQ ID NO: 6181 - DNA, 500 bp, synthetic construct; identical to SEQ ID NO: 204
  misc_feature 1..500: note = Synthetic polypeptide
  source 1..500: mol_type = other DNA

SEQ ID NO: 6182 - DNA, 656 bp, synthetic construct; identical to SEQ ID NO: 205
  misc_feature 1..656: note = Synthetic polypeptide
  source 1..656: mol_type = other DNA

SEQ ID NO: 6183 - DNA, 524 bp, synthetic construct; identical to SEQ ID NO: 207
  misc_feature 1..524: note = Synthetic polypeptide
  source 1..524: mol_type = other DNA

SEQ ID NO: 6184 - DNA, 1041 bp, synthetic construct; identical to SEQ ID NO: 969
  misc_feature 1..1041: note = Synthetic polypeptide
  source 1..1041: mol_type = other DNA

SEQ ID NO: 6185 - DNA, 1372 bp, synthetic construct; identical to SEQ ID NO: 1756
  misc_feature 1..1372: note = Synthetic polypeptide
  source 1..1372: mol_type = other DNA

SEQ ID NO: 6186 - DNA, 3308 bp, synthetic construct; identical to SEQ ID NO: 428
  misc_feature 1..3308: note = Synthetic polypeptide
  source 1..3308: mol_type = other DNA

SEQ ID NO: 6187 - DNA, 3203 bp, synthetic construct; identical to SEQ ID NO: 429
  misc_feature 1..3203: note = Synthetic polypeptide
  source 1..3203: mol_type = other DNA

SEQ ID NO: 6188 - DNA, 2849 bp, synthetic construct; identical to SEQ ID NO: 430
  misc_feature 1..2849: note = Synthetic polypeptide
  source 1..2849: mol_type = other DNA

SEQ ID NO: 6189 - DNA, 388 bp, synthetic construct; identical to SEQ ID NO: 431
  misc_feature 1..388: note = Synthetic polypeptide
  source 1..388: mol_type = other DNA

SEQ ID NO: 6190 - DNA, 1065 bp, synthetic construct; identical to SEQ ID NO: 4373
  misc_feature 1..1065: note = Synthetic polypeptide
  source 1..1065: mol_type = other DNA

SEQ ID NO: 6191 - DNA, 4932 bp, synthetic construct; identical to SEQ ID NO: 3990
  misc_feature 1..4932: note = Synthetic polypeptide
  source 1..4932: mol_type = other DNA

SEQ ID NO: 6192 - DNA, 117 bp, synthetic construct; identical to SEQ ID NO: 928
  misc_feature 1..117: note = Synthetic polypeptide
  source 1..117: mol_type = other DNA

SEQ ID NO: 6193 - DNA, 51 bp, synthetic construct; identical to SEQ ID NO: 929
  misc_feature 1..51: note = Synthetic polypeptide
  source 1..51: mol_type = other DNA

SEQ ID NO: 6194 - DNA, 2409 bp, synthetic construct; identical to SEQ ID NO: 1481
  misc_feature 1..2409: note = Synthetic polypeptide
  source 1..2409: mol_type = other DNA

SEQ ID NO: 6195 - DNA, 1034 bp, synthetic construct; identical to SEQ ID NO: 4670
  misc_feature 1..1034: note = Synthetic polypeptide
  source 1..1034: mol_type = other DNA

SEQ ID NO: 6196 - DNA, 1586 bp, synthetic construct; identical to SEQ ID NO: 4671
  misc_feature 1..1586: note = Synthetic polypeptide
  source 1..1586: mol_type = other DNA

SEQ ID NO: 6197 - DNA, 1588 bp, synthetic construct; identical to SEQ ID NO: 4672
  misc_feature 1..1588: note = Synthetic polypeptide
  source 1..1588: mol_type = other DNA

SEQ ID NO: 6198 - DNA, 2362 bp, synthetic construct; identical to SEQ ID NO: 1664
  misc_feature 1..2362: note = Synthetic polypeptide
  source 1..2362: mol_type = other DNA

SEQ ID NO: 6199 - DNA, 2113 bp, synthetic construct; identical to SEQ ID NO: 1665
  misc_feature 1..2113: note = Synthetic polypeptide
  source 1..2113: mol_type = other DNA

SEQ ID NO: 6200 - DNA, 1399 bp, synthetic construct; identical to SEQ ID NO: 1666
  misc_feature 1..1399: note = Synthetic polypeptide
  source 1..1399: mol_type = other DNA

SEQ ID NO: 6201 - DNA, 2080 bp, synthetic construct; identical to SEQ ID NO: 1667
  misc_feature 1..2080: note = Synthetic polypeptide
  source 1..2080: mol_type = other DNA

SEQ ID NO: 6202 - DNA, 2849 bp, synthetic construct; identical to SEQ ID NO: 1326
  misc_feature 1..2849: note = Synthetic polypeptide
  source 1..2849: mol_type = other DNA

SEQ ID NO: 6203 - DNA, 1925 bp, synthetic construct; identical to SEQ ID NO: 1327
  misc_feature 1..1925: note = Synthetic polypeptide
  source 1..1925: mol_type = other DNA

SEQ ID NO: 6204 - DNA, 2729 bp, synthetic construct; identical to SEQ ID NO: 1328
  misc_feature 1..2729: note = Synthetic polypeptide
  source 1..2729: mol_type = other DNA

SEQ ID NO: 6205 - DNA, 2549 bp, synthetic construct; identical to SEQ ID NO: 1329
  misc_feature 1..2549: note = Synthetic polypeptide
  source 1..2549: mol_type = other DNA

SEQ ID NO: 6206 - DNA, 15330 bp, synthetic construct; identical to SEQ ID NO: 1467
  misc_feature 1..15330: note = Synthetic polypeptide
  source 1..15330: mol_type = other DNA

SEQ ID NO: 6207 - DNA, 15330 bp, synthetic construct; identical to SEQ ID NO: 1468
  misc_feature 1..15330: note = Synthetic polypeptide
  source 1..15330: mol_type = other DNA

SEQ ID NO: 6208 - DNA, 15345 bp, synthetic construct; identical to SEQ ID NO: 1469
  misc_feature 1..15345: note = Synthetic polypeptide
  source 1..15345: mol_type = other DNA

SEQ ID NO: 6209 - DNA, 1743 bp, synthetic construct; identical to SEQ ID NO: 1253
  misc_feature 1..1743: note = Synthetic polypeptide
  source 1..1743: mol_type = other DNA

SEQ ID NO: 6210 - DNA, 1518 bp, synthetic construct; identical to SEQ ID NO: 1254
  misc_feature 1..1518: note = Synthetic polypeptide
  source 1..1518: mol_type = other DNA

SEQ ID NO: 6211 - DNA, 1767 bp, synthetic construct; identical to SEQ ID NO: 1255
  misc_feature 1..1767: note = Synthetic polypeptide
  source 1..1767: mol_type = other DNA

SEQ ID NO: 6212 - DNA, 1052 bp, synthetic construct; identical to SEQ ID NO: 247
  misc_feature 1..1052: note = Synthetic polypeptide
  source 1..1052: mol_type = other DNA

SEQ ID NO: 6213 - DNA, 327 bp, synthetic construct; identical to SEQ ID NO: 246
  misc_feature 1..327: note = Synthetic polypeptide
  source 1..327: mol_type = other DNA

SEQ ID NO: 6214 - DNA, 1146 bp, synthetic construct; identical to SEQ ID NO: 988
  misc_feature 1..1146: note = Synthetic polypeptide
  source 1..1146: mol_type = other DNA

SEQ ID NO: 6215 - DNA, 2721 bp, synthetic construct; identical to SEQ ID NO: 962
  misc_feature 1..2721: note = Synthetic polypeptide
  source 1..2721: mol_type = other DNA

SEQ ID NO: 6216 - DNA, 2549 bp, synthetic construct; identical to SEQ ID NO: 963
  misc_feature 1..2549: note = Synthetic polypeptide
  source 1..2549: mol_type = other DNA

SEQ ID NO: 6217 - DNA, 559 bp, synthetic construct; identical to SEQ ID NO: 1701
  misc_feature 1..559: note = Synthetic polypeptide
  source 1..559: mol_type = other DNA

SEQ ID NO: 6218 - DNA, 2848 bp, synthetic construct; identical to SEQ ID NO: 3654
  misc_feature 1..2848: note = Synthetic polypeptide
  source 1..2848: mol_type = other DNA

SEQ ID NO: 6219 - DNA, 157 bp, synthetic construct; identical to SEQ ID NO: 1500
  misc_feature 1..157: note = Synthetic polypeptide
  source 1..157: mol_type = other DNA

SEQ ID NO: 6220 - DNA, 681 bp, synthetic construct; identical to SEQ ID NO: 911
  misc_feature 1..681: note = Synthetic polypeptide
  source 1..681: mol_type = other DNA

SEQ ID NO: 6221 - DNA, 391 bp, synthetic construct
  misc_feature 1..391: note = Synthetic polypeptide
  source 1..391: mol_type = other DNA
atgccccattccgtgaccctgcgcgggccttcgccctggggcttccgcctggtgggcggccgggacttcagcgcgcccctcaccatctcacgggagctagacggatcggcctgaattccactctgtcctgtgacttcccgcttagagccctccatggttcccagccacccaggagaaatgccagcttcccacccgggtgtacaagactctgcaatatctgatccctgcctcttctctgacttcatctctcccactctcccctcactcatgatgctccggccatacaaccttccttcttctttctctccagatatgccattatacatgctggtccttctgcctggaacactatctctccctcagatactctcttttcccttaccccctttgg

SEQ ID NO: 6222 - DNA, 671 bp, synthetic construct
  misc_feature 1..671: note = Synthetic polypeptide
  source 1..671: mol_type = other DNA
atgctatcacataatactatgatgaagcagagaaaacagcaagcaacagccatcatgaaggaagtccatggaaatgatgttgatggcatggacctgggcaaaaaggtcagcatccccagagacatcatgttggaagaattatcccatctcagtaaccgtggtgccaggctatttaagatgcgtcaaagaagatctgacaaatacacatttgaaaatttccagtatcaatctagagcacaaataaatcacagtattgctatgcagaatgggaaagtggatggaagtaacttggaaggtggttcgcagcaagcccccttgactcctcccaacaccccagatccacgaagccctccaaatccagacaacattgctccaggatattctggaccactgaaggaaattcctcctgaaaaattcaacaccacagctgtccctaagtactatcaatctccctgggaacaagccattagcaatgatccggagcttttagaggctttatatcctaaacttttcaagcctgaaggaaaggcagaactgcctgattacaggagctttaacaggggttcaagacttcattggaggaagtaaataaagatctggtggaaatagcaagacaactaaagctagaagtggagtgtggagatgtgactgaattgctgcaatctaaaaaa

SEQ ID NO: 6223 - DNA, 154 bp, synthetic construct; identical to SEQ ID NO: 2227
  misc_feature 1..154: note = Synthetic polypeptide
  source 1..154: mol_type = other DNA

SEQ ID NO: 6224 - DNA, 1747 bp, synthetic construct; identical to SEQ ID NO: 1654
  misc_feature 1..1747: note = Synthetic polypeptide
  source 1..1747: mol_type = other DNA

SEQ ID NO: 6225 - DNA, 1081 bp, synthetic construct; identical to SEQ ID NO: 986
  misc_feature 1..1081: note = Synthetic polypeptide
  source 1..1081: mol_type = other DNA

SEQ ID NO: 6226 - DNA, 1054 bp, synthetic construct; identical to SEQ ID NO: 987
  misc_feature 1..1054: note = Synthetic polypeptide
  source 1..1054: mol_type = other DNA

SEQ ID NO: 6227 - DNA, 137 bp, synthetic construct; identical to SEQ ID NO: 2996
  misc_feature 1..137: note = Synthetic polypeptide
  source 1..137: mol_type = other DNA

SEQ ID NO: 6228 - DNA, 1213 bp, synthetic construct; identical to SEQ ID NO: 1093
  misc_feature 1..1213: note = Synthetic polypeptide
  source 1..1213: mol_type = other DNA

SEQ ID NO: 6229 - DNA, 616 bp, synthetic construct; identical to SEQ ID NO: 1094
  misc_feature 1..616: note = Synthetic polypeptide
  source 1..616: mol_type = other DNA

SEQ ID NO: 6230 - DNA, 868 bp, synthetic construct; identical to SEQ ID NO: 1095
  misc_feature 1..868: note = Synthetic polypeptide
  source 1..868: mol_type = other DNA

SEQ ID NO: 6231 - DNA, 1737 bp, synthetic construct; identical to SEQ ID NO: 4980
  misc_feature 1..1737: note = Synthetic polypeptide
  source 1..1737: mol_type = other DNA

SEQ ID NO: 6232 - DNA, 1302 bp, synthetic construct; identical to SEQ ID NO: 4981
  misc_feature 1..1302: note = Synthetic polypeptide
  source 1..1302: mol_type = other DNA

SEQ ID NO: 6233 - DNA, 1455 bp, synthetic construct; identical to SEQ ID NO: 4982
  misc_feature 1..1455: note = Synthetic polypeptide
  source 1..1455: mol_type = other DNA

SEQ ID NO: 6234 - DNA, 1734 bp, synthetic construct; identical to SEQ ID NO: 4983
  misc_feature 1..1734: note = Synthetic polypeptide
  source 1..1734: mol_type = other DNA

SEQ ID NO: 6235 - DNA, 1379 bp, synthetic construct; identical to SEQ ID NO: 985
  misc_feature 1..1379: note = Synthetic polypeptide
  source 1..1379: mol_type = other DNA

SEQ ID NO: 6236 - DNA, 1063 bp, synthetic construct; identical to SEQ ID NO: 2221
  misc_feature 1..1063: note = Synthetic polypeptide
  source 1..1063: mol_type = other DNA

SEQ ID NO: 6237 - DNA, 377 bp, synthetic construct; identical to SEQ ID NO: 2235
  misc_feature 1..377: note = Synthetic polypeptide
  source 1..377: mol_type = other DNA

SEQ ID NO: 6238 - DNA, 347 bp, synthetic construct; identical to SEQ ID NO: 2236
  misc_feature 1..347: note = Synthetic polypeptide
  source 1..347: mol_type = other DNA

SEQ ID NO: 6239 - DNA, 4997 bp, synthetic construct
  misc_feature 1..4997: note = Synthetic polypeptide
  source 1..4997: mol_type = other DNA
atggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaagaaatatattcagatcttagagataatctgacagcattccaaaaatacctgattgagagtaacaaacaaatgatgcctttgaaagtctgggaactacaagatcttagttttcaagcagcttctcaaataatgtccgctccagtttatgattccattaaattaatgaaagacatttcacagaacttccccataaaagccagatctctaaccagaattgctgtaaatcaacatatgagagaagaaataaaggaaaatcaaaaggatcttcaagttagatttaaaattcagccaggcgatgctcgtctatttataaatggccttcgtgttgatatggatgtttatgacgcttttagtattttggatatgctgaaattagaaggaaaaatgatgaatggccttcgcaatcttgggatcaatggggaagatatgagcaaatttttaaaattaaattcacacatttgggaatatacttatgtattagatattcgacattcttctataatgtggattaatgacttagaaaatgatgatttgtatattacatggcctacaagttgccagaaacttctgaagccagtatttcctggaagtgtaccttccataaggcgcaattttcataatttggttctgtttattgatccggcccaagaatataccttggattttataaaacttgctgatgttttctattctcacgaagttcctcttagaattggttttgtgttcattcttaatacagatgatgaagttgatggagcaaatgatgctggagttgctctctggcgagctttcaactatattgcagaagaatttgatatatcagaagcatttatttctatagtacacatgtaccaaaaagtgaagaaggatcaaaatatactcactgtggacaatgtgaagagtgttctccaaaatacatttcctcatgctaatatttgggatattttgggaattcattctaaatatgatgaagaaagaaaggctggagcaagcttttataagatgactggcctgggtcctttgcctcaagctctttataatggtgaaccctttaaacatgaagagatgaatattaaagaactaaaaatggctgttcttcaaagaatgatggatgcatctgtatatttacaaagagaagtttttttgggcacattaaatgatcgcacgaatgcaattgattttctaatggataggaataatgttgtaccccgtataaatactttgattttgcgtactaaccagcagtacctcaatttaatatctacatcagtaactgctgatgttgaagatttctctactttctttttcttggattcacaagataagagtgctgtaattgcaaagaacatgtattatttaacccaagacgatgagagtataatttctgcagtcactctctggattattgcagattttgataagccttctgggagaaaacttctttttaatgcattaaagcacatgaaaacaagtgttcatagtcggttggggattatttataatcctacatcaaaaataaatgaagagaacacagctatttctagaggaattttggcagcttttcttacacagaagaacatgtttttgagaagctttcttgggcaactggcaaaggaagaaattgctacagctatttactctggagataaaattaaaacattccttattgaggggatggataagaatgcttttgagaaaaaatataatactgttggagtgaatatttttcgaactcaccagttgttctgtcaagatgtacttaaattacgtcctggagaaatgggtattgtcagcaatgggagattcttaggacctttagatgaagatttttatgcagaagatttttacttgttggaaaagataacatttagtaatttaggagagaaaattaaaggcattgttgaaaatatgggaatcaacgcaaataacatgagtgactttattatgaaagttgatgcccttatgtcctctgtgcctaagcgtgcatctcgatatgatgtcacatttcttagggagaatcacagtgttataaagacgaatcctcaagagaatgatatgttcttcaatgtcattgctattgttgatccattaacaagagaagcacagaaaatggcacagttgttggttgtacttggcaagattatcaacatgaagataaagttgttcatgaactgtaggggcaggctttcagaagcccctttagaaagcttttaccgttttgttctggaaccagaactgatgtcaggggctaatgacgtttcttctcttggaccagtggcaaaatttttggatattcctgaatcacccctcctaatcctcaacatgattactccagaaggctggttggttgaaacagtgcacagcaactgtgaccttgataatattcacttaaaggatactgagaaaactgttacagcagaatatgaactagaatacttactactggaaggacaatgctttgataaagtgacagaacagcctcctcggggtctgcagttcacactaggcacaaaaaataaacctgctgtggttgatacaatagtgatggcacatcatgggtattttcaattaaaagcaaacccaggtgcttggatactgaggttacaccaaggaaaatctgaagatatttatcaaatagttgggcatgaaggaactgactctcaagcagacctagaagatatcattgttgtattaaacagcttcaaaagcaagatactcaaagtaaaagtgaaaaaagaaacagacaaaattaaggaagatatccttaccgatgaagatgaaaaaacaaaaggactgtgggattccattaaaagtttcacagtaagcttgcataaagaaaacaaaaaggaaaaagatgtcctaaacattttttcagttgcttctggtcatttatatgaacgttttttaagaattatgatgctttctgttttgcgtaacaccaaaacaccagtgaaattctggttgctaaaaaattatctctcaccgacatttaaagaagtaattcctcacatggctaaagagtatggattccgatatgaactagttcaatataggtggccccgttggcttcgtcaacagactgaaagacagaggattatttggggttacaaaattcttttccttgatgttcttttcccactagcagtggacaaaatcatttttgttgatgctgaccagattgtgagacatgatctaaaagaacttcgagatttcgatctggatggagctccttatgggtatactccattttgtgatagccgcagggaaatggatggatatcgtttctggaaaacaggatactgggcatcacatcttttaagacggaaataccatatcagtgctttatatgtagtggatctcaagaagttcaggagaattggagcaggtgacaggctcaggagccagtatcaagctctcagtcaagatccaaacagtctttcaaacctagatcaggaagtgaggagcgtctctgcccggccgcccatcatctgggatgtggggagcgcctctgccccgccaccccgccaccccgtctgagatgtgaagagcgcctctgcccggccgcgaccccgtctgggaactgaggagtgtctctgccccgccgccaccccgtctgggaagtgaggagcgtctctgaccagccgccaccctgtctgggaggtgtacccaacagctcattgagaacgggccatgatgacgatggcggttttgtcgaatagaaaagggggaaatgtggggaaaagaaagagagatcagattgttactgtgtctgtgtagaaagaagtagacataggagactccattttgttctgtactaagaaaaattcttctgccttgggatgctgttaatctataaccttacccccaaccccgtgctctctgaaacatgtgctttgtccactaagggttaaatggattaagggcggtgcaagatgtgctttgttaaacagatgcttgaaggcagcataccagtcatcaccactccctaatctcaagtacccagggacacaaacactgcggaaggcggcagggccctctgcctaggaaaaccagagacctttgttcacaagtttatctgctgaccttccctccactattgtcctatgaccccgccaaatcccgctctccgagaaacacccaagaatgatcaataaatactaaaaaaa

SEQ ID NO: 6240 - DNA, 569 bp, synthetic construct; identical to SEQ ID NO: 1768
  misc_feature 1..569: note = Synthetic polypeptide
  source 1..569: mol_type = other DNA

SEQ ID NO: 6241 - DNA, 497 bp, synthetic construct; identical to SEQ ID NO: 1769
  misc_feature 1..497: note = Synthetic polypeptide
  source 1..497: mol_type = other DNA

SEQ ID NO: 6242 - DNA, 338 bp, synthetic construct
  misc_feature 1..338: note = Synthetic polypeptide
  source 1..338: mol_type = other DNA
atgatggcagaagagcacacagatctcgaggcccagatcgtcaaggatatccactgcaaggagattgacctggtgaaccgagaccccaagaacattaacgaggacatagtcaagactggagaaaatggaaaaagagaataccccggaggaatctgaagctctcaaacacttctggtaagaatgcattttggagtagcctccttcaaaggaagaaatttaacaatatatataaattgcctttaaaatgtgcatgccttttgacacagtaattaacccttctaatgatgtaacttgaggaaatgattgggcaaaaatgcaaagaggtatgtatacagatg

SEQ ID NO: 6243 - DNA, 1898 bp, synthetic construct; identical to SEQ ID NO: 2282
  misc_feature 1..1898: note = Synthetic polypeptide
  source 1..1898: mol_type = other DNA

SEQ ID NO: 6244 - DNA, 1865 bp, synthetic construct; identical to SEQ ID NO: 2283
  misc_feature 1..1865: note = Synthetic polypeptide
  source 1..1865: mol_type = other DNA

SEQ ID NO: 6245 - DNA, 764 bp, synthetic construct; identical to SEQ ID NO: 2284
  misc_feature 1..764: note = Synthetic polypeptide
  source 1..764: mol_type = other DNA

SEQ ID NO: 6246 - DNA, 5018 bp, synthetic construct; identical to SEQ ID NO: 4912
  misc_feature 1..5018: note = Synthetic polypeptide
  source 1..5018: mol_type = other DNA

SEQ ID NO: 6247 - DNA, 5270 bp, synthetic construct; identical to SEQ ID NO: 4913
  misc_feature 1..5270: note = Synthetic polypeptide
  source 1..5270: mol_type = other DNA

SEQ ID NO: 6248 - DNA, 67 bp, synthetic construct; identical to SEQ ID NO: 5156
  misc_feature 1..67: note = Synthetic polypeptide
  source 1..67: mol_type = other DNA

SEQ ID NO: 6249 - DNA, 575 bp, synthetic construct; identical to SEQ ID NO: 5160
  misc_feature 1..575: note = Synthetic polypeptide
  source 1..575: mol_type = other DNA

SEQ ID NO: 6250 - DNA, 1412 bp, synthetic construct; identical to SEQ ID NO: 5151
  misc_feature 1..1412: note = Synthetic polypeptide
  source 1..1412: mol_type = other DNA

SEQ ID NO: 6251 - DNA, 434 bp, synthetic construct; identical to SEQ ID NO: 992
  misc_feature 1..434: note = Synthetic polypeptide
  source 1..434: mol_type = other DNA

SEQ ID NO: 6252 - DNA, 860 bp, synthetic construct; identical to SEQ ID NO: 2285
  misc_feature 1..860: note = Synthetic polypeptide
  source 1..860: mol_type = other DNA

SEQ ID NO: 6253 - DNA, 1823 bp, synthetic construct; identical to SEQ ID NO: 2286
  misc_feature 1..1823: note = Synthetic polypeptide
  source 1..1823: mol_type = other DNA

SEQ ID NO: 6254 - DNA, 1796 bp, synthetic construct; identical to SEQ ID NO: 2287
  misc_feature 1..1796: note = Synthetic polypeptide
  source 1..1796: mol_type = other DNA

SEQ ID NO: 6255 - DNA, 875 bp, synthetic construct; identical to SEQ ID NO: 5161
  misc_feature 1..875: note = Synthetic polypeptide
  source 1..875: mol_type = other DNA

SEQ ID NO: 6256 - DNA, 2497 bp, synthetic construct; identical to SEQ ID NO: 5224
  misc_feature 1..2497: note = Synthetic polypeptide
  source 1..2497: mol_type = other DNA

SEQ ID NO: 6257 - DNA, 2569 bp, synthetic construct; identical to SEQ ID NO: 5225
  misc_feature 1..2569: note = Synthetic polypeptide
  source 1..2569: mol_type = other DNA

SEQ ID NO: 6258 - DNA, 1178 bp, synthetic construct; identical to SEQ ID NO: 1256
  misc_feature 1..1178: note = Synthetic polypeptide
  source 1..1178: mol_type = other DNA

SEQ ID NO: 6259 - DNA, 947 bp, synthetic construct; identical to SEQ ID NO: 1257
  misc_feature 1..947: note = Synthetic polypeptide
  source 1..947: mol_type = other DNA

SEQ ID NO: 6260 - DNA, 857 bp, synthetic construct; identical to SEQ ID NO: 1258
  misc_feature 1..857: note = Synthetic polypeptide
  source 1..857: mol_type = other DNA

SEQ ID NO: 6261 - DNA, 550 bp, synthetic construct; identical to SEQ ID NO: 3092
  misc_feature 1..550: note = Synthetic polypeptide
  source 1..550: mol_type = other DNA

SEQ ID NO: 6262 - DNA, 412 bp, synthetic construct; identical to SEQ ID NO: 3093
  misc_feature 1..412: note = Synthetic polypeptide
  source 1..412: mol_type = other DNA

SEQ ID NO: 6263 - DNA, 18 bp, synthetic construct
  misc_feature 1..18: note = Synthetic polypeptide
  source 1..18: mol_type = other DNA
atgttagcatttaagaga

SEQ ID NO: 6264 - DNA, 318 bp, synthetic construct
  misc_feature 1..318: note = Synthetic polypeptide
  source 1..318: mol_type = other DNA
atggcccaagccctgccctggctcctgctgtggatgggcgcgggagtgctgcctgcccacggcacccagcacggcatccggctgcccctgcgcagcggcctggggggcgcccccctggggctgcggctgccccgggagaccgacgaagagcccgaggagcccggccggaggggcagctttgtggagatggtggacaacctgaggggcaagtcggggcagggctactacgtggagatgaccgtgggcagccccccgcagacgttggtttttcagcagacctgcagagggcacaggggaagtgttcctttggcccctgca

SEQ ID NO: 6265 - DNA, 15330 bp, synthetic construct; identical to SEQ ID NO: 1467
  misc_feature 1..15330: note = Synthetic polypeptide
  source 1..15330: mol_type = other DNA

SEQ ID NO: 6266 - DNA, 15330 bp, synthetic construct; identical to SEQ ID NO: 1468
  misc_feature 1..15330: note = Synthetic polypeptide
  source 1..15330: mol_type = other DNA

SEQ ID NO: 6267 - DNA, 15345 bp, synthetic construct; identical to SEQ ID NO: 1469
  misc_feature 1..15345: note = Synthetic polypeptide
  source 1..15345: mol_type = other DNA

SEQ ID NO: 6268 - DNA, 154 bp, synthetic construct; identical to SEQ ID NO: 2227
  misc_feature 1..154: note = Synthetic polypeptide
  source 1..154: mol_type = other DNA

SEQ ID NO: 6269 - DNA, 637 bp, synthetic construct
  misc_feature 1..637: note = Synthetic polypeptide
  source 1..637: mol_type = other DNA
atgttccagaacctgcaaggaacatttgaaaaggaaattggaaaaataattccatttaccatagcatttaagagagctgaggctgtggagccagatggctgcgttcagagctggcgctgctgtttaccatgtgaccttggacaagcttctcgcttcattcataccacagtttgttcggctattaggtggaggagctgtaagggggagaggaactttgctgaaaggcacatcctccctgcagagcttgaagaacaatctaaccatgctggcatggggcccatcctacctgcaatgccaagaccctgcacttgatggatcagctcagtaaactgactcatctgatcttgtggccccttctcaggaactgactcagcacaagaagacagcttcgactccctatgatttcatctctgaccaatcagcactcctggcacactggcttcccccaacccaccaagttatccttaaaaactccattccctgattgctaggggagacagatttgagtaataataaaactccggtctcccccacagctggctctgcacgaattactcttcttctattgcaattcccctgtcttgatgaatcggctctgtctaggcagcaggcaaggtgaaccctttgagcagttaca

SEQ ID NO: 6270 - DNA, 767 bp, synthetic construct; identical to SEQ ID NO: 937
  misc_feature 1..767: note = Synthetic polypeptide
  source 1..767: mol_type = other DNA

SEQ ID NO: 6271 - DNA, 677 bp, synthetic construct; identical to SEQ ID NO: 938
  misc_feature 1..677: note = Synthetic polypeptide
  source 1..677: mol_type = other DNA

SEQ ID NO: 6272 - DNA, 802 bp, synthetic construct; identical to SEQ ID NO: 2212
  misc_feature 1..802: note = Synthetic polypeptide
  source 1..802: mol_type = other DNA

SEQ ID NO: 6273 - DNA, 2141 bp, synthetic construct; identical to SEQ ID NO: 2213
  misc_feature 1..2141: note = Synthetic polypeptide
  source 1..2141: mol_type = other DNA

SEQ ID NO: 6274 - DNA, 2192 bp, synthetic construct; identical to SEQ ID NO: 2214
  misc_feature 1..2192: note = Synthetic polypeptide
  source 1..2192: mol_type = other DNA

SEQ ID NO: 6275 - DNA, 2015 bp, synthetic construct; identical to SEQ ID NO: 2215
  misc_feature 1..2015: note = Synthetic polypeptide
  source 1..2015: mol_type = other DNA

SEQ ID NO: 6276 - DNA, 2109 bp, synthetic construct
  misc_feature 1..2109: note = Synthetic polypeptide
  source 1..2109: mol_type = other DNA
atggccccgctggttccaggacctcccctcgaagcctcacccaccaccctggatgcagcagtcagatgggggcttcagaggccggtgcgcggccacatggccccgggccaggcagggggtcgtggggacgcatctgcgctaggcgcacagtattcctgggcgcgggacgggcgaagcgccgtgggttccaagctgagctgggtcggccctgcagcgccggagagcaaggcggcgcagggaagggagatggggcgggatgtggggaaagctgtcgactgcttggatctctccggcccggatggcgccagctgcctccagctcagcctgcggaaatccgagctcttcccagcggcccgacggcccgggcgccccgcagaccctgggctctccccgcggtgcctccgccgcccgcccctgcgtcctggcccggcctccacgcccctccgaggtcccggcgcagcgcggccgccgccactccccccacattccagaggccgcagcgccgtctccttcctcgcattcctgcccccgcaaaggagtccctccgccccgcgcgaggccgcggggtcccggggcgggctccgggcttcgggcggacgatgcggcggcccggccggagcggcggcgggaagcggaggcggaggtgacgcgccagggccggcgggccgggccatgcagcgctccagggcgggcgcggacgaggcggccctactcctggccgggctggccctgcgggagctggagcccgggtgcggctctcccggtcgggggcggcgggggccgcggcctgggcctggagacgaggcggcgcccgcgctgggccgcagagggaagggcagcggcggccccgaggccggggcggacggactgagccgcggggagcggggtccccggcgcgcggcggttccggagctcagcgcgcagcctgcgggcagcccacgggccagcctggcggggtccgacggcggcggcggtggcggcagcgcccgatccagcggcatcagcctgggctacgaccagcgccacggcagcccgcgctccggtcgctcggacccgcgtcccggtcccgggccgccttcggtgggcagcgcccgctccagcgtttccagcctcggctcccggggctcggccggcgcctacgctgacttcctcccgcccggcgcctgccccgcgcccgctcgctccccggagcctgcggggccggctcccttcccgctgcctgcactcccgctgccccctggccgggagggcggcccaagcgcggccgagcggcggctggaggcgctcacccgggagctggagcgggcgctcgaggcgcgcacggcgcgggactacttcggcatttgcatcaagtgtgggcttggcatctacggagcccagcaggcgtgccaggcaatggggagtctttatcacactgactgcttcacctgcgactcgtgtgggagacgactccgtgggaaggcgttctacaacgtgggtgagaaagtgtactgccaggaggacttcctgtactccgggttccagcagacggccgacaaatgcagcgtgtgtggacatctcatcatggaaatgatcctgcaggccctgggcaagtcctaccacccaggctgcttccggtgctccgtgtgcaatgagtgcctggacggggttcccttcaccgtggacgtggagaacaacatctactgcgtgcgagactatcacacggtttttgcaccaaaatgcgcctcctgtgcccgtcctatcctccctgcacagggctgcgagacaaccatccgtgtggtgtccatggacagagactaccacgtggcatgttaccactgtgaggctcggtggttcatgcctgtaatcccagcactttgggaggctgaggagggtggatcacctgaggtcaggagttcgagaccagcctggccaacatggtgaaaccccgtctctactaaaaatacaaaaattagccaggcgtggtggcgggcacctgtagtcccagctactcaggaggctgaggtaggagaatcgcttgaacctgggaggcagaggttgcagtgagccgagattgtgccattgcactccagcctgggcaacaagagtgagactctgtctcaaaaaaaa

SEQ ID NO: 6277 - DNA, 1437 bp, synthetic construct
  misc_feature 1..1437: note = Synthetic polypeptide
  source 1..1437: mol_type = other DNA
atgcagcgctccagggcgggcgcggacgaggcggccctactcctggccgggctggccctgcgggagctggagcccgggtgcggctctcccggtcgggggcggcgggggccgcggcctgggcctggagacgaggcggcgcccgcgctgggccgcagagggaagggcagcggcggccccgaggccggggcggacggactgagccgcggggagcggggtccccggcgcgcggcggttccggagctcagcgcgcagcctgcgggcagcccacgggccagcctggcggggtccgacggcggcggcggtggcggcagcgcccgatccagcggcatcagcctgggctacgaccagcgccacggcagcccgcgctccggtcgctcggacccgcgtcccggtcccgggccgccttcggtgggcagcgcccgctccagcgtttccagcctcggctcccggggctcggccggcgcctacgctgacttcctcccgcccggcgcctgccccgcgcccgctcgctccccggagcctgcggggccggctcccttcccgctgcctgcactcccgctgccccctggccgggagggcggcccaagcgcggccgagcggcggctggaggcgctcacccgggagctggagcgggcgctcgaggcgcgcacggcgcgggactacttcggcatttgcatcaagtgtgggcttggcatctacggagcccagcaggcgtgccaggcaatggggagtctttatcacactgactgcttcacctgcgactcgtgtgggagacgactccgtgggaaggcgttctacaacgtgggtgagaaagtgtactgccaggaggacttcctgtactccgggttccagcagacggccgacaaatgcagcgtgtgtggacatctcatcatggaaatgatcctgcaggccctgggcaagtcctaccacccaggctgcttccggtgctccgtgtgcaatgagtgcctggacggggttcccttcaccgtggacgtggagaacaacatctactgcgtgcgagactatcacacggtttttgcaccaaaatgcgcctcctgtgcccgtcctatcctccctgcacagggctgcgagacaaccatccgtgtggtgtccatggacagagactaccacgtggcatgttaccactgtgaggctcggtggttcatgcctgtaatcccagcactttgggaggctgaggagggtggatcacctgaggtcaggagttcgagaccagcctggccaacatggtgaaaccccgtctctactaaaaatacaaaaattagccaggcgtggtggcgggcacctgtagtcccagctactcaggaggctgaggtaggagaatcgcttgaacctgggaggcagaggttgcagtgagccgagattgtgccattgcactccagcctgggcaacaagagtgagactctgtctcaaaaaaaa

SEQ ID NO: 6278 - DNA, 884 bp, synthetic construct
  misc_feature 1..884: note = Synthetic polypeptide
  source 1..884: mol_type = other DNA
tcccgctgccccctggccgggagggcggcccaagcgcggccgagcggcggctggaggcgctcacccgggagctggagcgggcgctcgaggcgcgcacggcgcgggactacttcggcatttgcatcaagtgtgggcttggcatctacggagcccagcaggcgtgccaggcaatggggagtctttatcacactgactgcttcacctgcgactcgtgtgggagacgactccgtgggaaggcgttctacaacgtgggtgagaaagtgtactgccaggaggacttcctgtactccgggttccagcagacggccgacaaatgcagcgtgtgtggacatctcatcatggaaatgatcctgcaggccctgggcaagtcctaccacccaggctgcttccggtgctccgtgtgcaatgagtgcctggacggggttcccttcaccgtggacgtggagaacaacatctactgcgtgcgagactatcacacggtttttgcaccaaaatgcgcctcctgtgcccgtcctatcctccctgcacagggctgcgagacaaccatccgtgtggtgtccatggacagagactaccacgtggcatgttaccactgtgaggctcggtggttcatgcctgtaatcccagcactttgggaggctgaggagggtggatcacctgaggtcaggagttcgagaccagcctggccaacatggtgaaaccccgtctctactaaaaatacaaaaattagccaggcgtggtggcgggcacctgtagtcccagctactcaggaggctgaggtaggagaatcgcttgaacctgggaggcagaggttgcagtgagccgagattgtgccattgcactccagcctgggcaacaagagtgagactctgtctcaaaaaaaa

SEQ ID NO: 6279 - DNA, 806 bp, synthetic construct; identical to SEQ ID NO: 974
  misc_feature 1..806: note = Synthetic polypeptide
  source 1..806: mol_type = other DNA

SEQ ID NO: 6280 - DNA, 591 bp, synthetic construct
  misc_feature 1..591: note = Synthetic polypeptide
  source 1..591: mol_type = other DNA
atgcagcagagaggactcgccatcgtggccttggctgtctgtgcggccctacatgcctcagaagccatacttcccattgcctccagctgttgcacggaggtttcacatcatatttccagaaggctcctggaaagagtgaatatgtgtcgcatccagagagctgatggggattgtgacttggctgctgtcatccttcatgtcaagcgcagaagaatctgtgtcagcccgcacaaccatactgttaagcagtggatgaaagtgcaagctgccaagaaaaatggtcctgcatactgatgaaactactgatgtcagctggtctgaaggaccctaccagaagctaaatcatcaaagaatgcaatttccatatcctaatgattcaatctcccttaccctgaccaatcagtggcccaaattttccagccccttgcctcccagaaccccagcccagaactcttcagagatttaagaatctcctcctacctcctgactcagcaccatgtaatcattaaactctctgctgcaaactctgctgtctcaatgtatcagtctgttactgcacagtgggtgtatgaacctgttggtcttatgaca

SEQ ID NO: 6281 - DNA, 450 bp, synthetic construct
  misc_feature 1..450: note = Synthetic polypeptide
  source 1..450: mol_type = other DNA
atgtgtcgcatccagagagctgatggggattgtgacttggctgctgtcatccttcatgtcaagcgcagaagaatctgtgtcagcccgcacaaccatactgttaagcagtggatgaaagtgcaagctgccaagaaaaatggtcctgcatactgatgaaactactgatgtcagctggtctgaaggaccctaccagaagctaaatcatcaaagaatgcaatttccatatcctaatgattcaatctcccttaccctgaccaatcagtggcccaaattttccagccccttgcctcccagaaccccagcccagaactcttcagagatttaagaatctcctcctacctcctgactcagcaccatgtaatcattaaactctctgctgcaaactctgctgtctcaatgtatcagtctgttactgcacagtgggtgtatgaacctgttggtcttatgaca

SEQ ID NO: 6282 - DNA, 1177 bp, synthetic construct
  misc_feature 1..1177: note = Synthetic polypeptide
  source 1..1177: mol_type = other DNA
atggggctcccgcgcgggtcgttcttctggctgctgctcctgctcacggctgcctgctcggggctcctctttgccctgtacttctcggcggtgcagcggtacccggggccagcggccggagccagggacaccacatcatttgaagcattctttcaatccaaggcatcgaattcttggacaggaaagggccaggcctgccgacacctgcttcacctggccattcagcggcacccccacttccgtggcctgttcaatctctccattccagtgctgctgtggggggacctcttcaccccagcgctctgggaccgcctgagccaacacaaagccccgtatggctggcgggggctctctcaccaagtcatcgcctccaccctgagccttctgaacggctcagagagtgccaagctgtttgccccgcccagggacacccctccaaagtgtatccggtgtgccgtggtgggcaacggaggcattctgaatgggtcccgccagggtcccaacatcgatgcccatgactatgtattcagactcaatggagctgtgatcaaaggcttcgagcgcgatgtgggcaccaagacttccttctatggtttcactgtgaacacgatgaagaactccctcgtctcctactggaatctgggcttcacctccgtgccacaaggacaggacctgcagtatatcttcatcccctcagacatccgcgactatgtgatgctgagatcggccattctgggcgtgcctgtccctgagggcctagataaaggggacaggccgcacgcctattttggaccagaagcctctgccagtaaattcaagctgctacatccggacttcatcagctacctgacagaaaggttcttgaaatcaaagttgattaacacacattttggagacctatatatgcctagtaccggggctctcatgctgctgacagctttgcatacctgtgaccagaaggtacgcgcctgtagtcccagcactcaggaggctgagccaggagaattgcttgaacccgggaggtggaggttgcagtgagccaagattgtaccacttcactccagcctggcgacagagtggaactccgtctcaaaaaataaaataaaataaaataaaataaaataaaataaaataaaataaagcaaaaatataaaatgttaaaaaaaaaacaaaaaaa

SEQ ID NO: 6283 - DNA, 718 bp, synthetic construct
  misc_feature 1..718: note = Synthetic polypeptide
  source 1..718: mol_type = other DNA
ctgagccttctgaacggctcagagagtgccaagctgtttgccccgcccagggacacccctccaaagtgtatccggtgtgccgtggtgggcaacggaggcattctgaatgggtcccgccagggtcccaacatcgatgcccatgactatgtattcagactcaatggagctgtgatcaaaggcttcgagcgcgatgtgggcaccaagacttccttctatggtttcactgtgaacacgatgaagaactccctcgtctcctactggaatctgggcttcacctccgtgccacaaggacaggacctgcagtatatcttcatcccctcagacatccgcgactatgtgatgctgagatcggccattctgggcgtgcctgtccctgagggcctagataaaggggacaggttcttgaaatcaaagttgattaacacacattttggagacctatatatgcctagtaccggggctctcatgctgctgacagctttgcatacctgtgaccagaaggtacgcgcctgtagtcccagcactcaggaggctgagccaggagaattgcttgaacccgggaggtggaggttgcagtgagccaagattgtaccacttcactccagcctggcgacagagtggaactccgtctcaaaaaataaaataaaataaaataaaataaaataaaataaaataaaataaagcaaaaatataaaatgttaaaaaaaaaacaaaaaaa

SEQ ID NO: 6284 - DNA, 220 bp, synthetic construct
  misc_feature 1..220: note = Synthetic polypeptide
  source 1..220: mol_type = other DNA
atggtgggccccgcgccgcggcggcggctgcggccgctggcagcgctggccctggtcctggcgctggccccggggctgcccacagcccgggccgggcagacaccgcgccctgccgagcgggggcccccagtgcggcttttcaccgaggaggagctggcccgctatggcggggaggagggactctccaactgacccgatgatctttgggaccactggcaca

SEQ ID NO: 6285 - DNA, 1288 bp, synthetic construct; identical to SEQ ID NO: 2642
  misc_feature 1..1288: note = Synthetic polypeptide
  source 1..1288: mol_type = other DNA

SEQ ID NO: 6286 - DNA, 625 bp, synthetic construct; identical to SEQ ID NO: 2643
  misc_feature 1..625: note = Synthetic polypeptide
  source 1..625: mol_type = other DNA

SEQ ID NO: 6287 - DNA, 700 bp, synthetic construct; identical to SEQ ID NO: 2644
  misc_feature 1..700: note = Synthetic polypeptide
  source 1..700: mol_type = other DNA

SEQ ID NO: 6288 - DNA, 778 bp, synthetic construct; identical to SEQ ID NO: 2645
  misc_feature 1..778: note = Synthetic polypeptide
  source 1..778: mol_type = other DNA

SEQ ID NO: 6289 - DNA, 238 bp, synthetic construct; identical to SEQ ID NO: 2646
  misc_feature 1..238: note = Synthetic polypeptide
  source 1..238: mol_type = other DNA

SEQ ID NO: 6290 - DNA, 107 bp, synthetic construct; identical to SEQ ID NO: 5502
  misc_feature 1..107: note = Synthetic polypeptide
  source 1..107: mol_type = other DNA

SEQ ID NO: 6291 - DNA, 697 bp, synthetic construct
  misc_feature 1..697: note = Synthetic polypeptide
  source 1..697: mol_type = other DNA
atggcggacgagaaggacagggaagagataatagtagcagaatttcacaaaaaaatcaaagaggcatttgaagtctttgaccatgagtcgaataatacagtggatgtgagagagattggaacaattatcaggtcattaggatgctgtcctacggaaggagagctgcatgatctgattgcagaggtagaggaagaagaacccactggatacattcgattcgaaaaatttcttccggtgatgacagaaatactactagaaagaaaatacagaccaattccagaagatgtccttcttcgagcttttgaggttttagattcagctaaacgtgggtttcttactaaggacgagctgatcaagtatatgactgaagaagatcctgaattccagcaaaacagccgacaccaaccagtttgaagacccccacagaggaatgtgatcagcatgaaaatacagcttcgtctccctctcccatgactccaccctgcacacttcgaccaatcaaccatctccacactccagtctccactcccaaacccttaaaaaccccagccccaaactcctcagggagatggatttgacgtttcctcccatttcctccttcggtggccctacgatgaaacctctttctctgctacaaccctatgcctcggcgtattcactttctggtcccatccagcgatggacccatcgtggttac

SEQ ID NO: 6292 - DNA, 1105 bp, synthetic construct
  misc_feature 1..1105: note = Synthetic polypeptide
  source 1..1105: mol_type = other DNA
atgctaggcccgggacaagtccggctccggcctcgggtctggagggacaaggccgggggccgggtggcagacggggcctctggtcttcccccagcgcgagggtcgtggcgcgaaacggggacagggcgcgcgctcggagcctcctccccgccccgccccgcccaagggtcttcctcccccgggattcagagcggcccctcctccaggccaggctcgccgcggggcgctgagcaggccgggacaccgcggccgaggttatcgttaggcatctcccaggcgaccggctccgcagcaagatggcggacgagaaggacagggaagggcctgggatacaacagtgatgagataaggcctcggactttactgatcgaacatctaatggaaggtggaagaagagaccatcacacaatgacggtgttatggggaacacaggagataatagtagcagaatttcacaaaaaaatcaaagaggcatttgaagtctttgaccatgagtcgaataatacagtggatgtgagagagattggaacaattatcaggtcattaggatgctgtcctacggaaggagagctgcatgatctgattgcagaggtagaggaagaagaacccactggatacattcgattcgaaaaatttcttccggtgatgacagaaatactactagaaagaaaatacagaccaattccagaagatgtccttcttcgagcttttgaggttttagattcagctaaacgtgggtttcttactaaggacgagctgatcaagtatatgactgaagaagatcctgaattccagcaaaacagccgacaccaaccagtttgaagacccccacagaggaatgtgatcagcatgaaaatacagcttcgtctccctctcccatgactccaccctgcacacttcgaccaatcaaccatctccacactccagtctccactcccaaacccttaaaaaccccagccccaaactcctcagggagatggatttgacgtttcctcccatttcctccttcggtggccctacgatgaaacctctttctctgctacaaccctatgcctcggcgtattcactttctggtcccatccagcgatggacccatcgtggttac

SEQ ID NO: 6293 - DNA, 872 bp, synthetic construct
  misc_feature 1..872: note = Synthetic polypeptide
  source 1..872: mol_type = other DNA
ggccgggacaccgcggccgaggttatcgttaggcatctcccaggcgaccggctccgcagcaagatggcggacgagaaggacagggaagggcctgggatacaacagtgatgagataaggcctcggactttactgatcgaacatctaatggaaggtggaagaagagaccatcacacaatgacggtgttatggggaacacaggagataatagtagcagaatttcacaaaaaaatcaaagaggcatttgaagtctttgaccatgagtcgaataatacagtggatgtgagagagattggaacaattatcaggtcattaggatgctgtcctacggaaggagagctgcatgatctgattgcagaggtagaggaagaagaacccactggatacattcgattcgaaaaatttcttccggtgatgacagaaatactactagaaagaaaatacagaccaattccagaagatgtccttcttcgagcttttgaggttttagattcagctaaacgtgggtttcttactaaggacgagctgatcaagtatatgactgaagaagatcctgaattccagcaaaacagccgacaccaaccagtttgaagacccccacagaggaatgtgatcagcatgaaaatacagcttcgtctccctctcccatgactccaccctgcacacttcgaccaatcaaccatctccacactccagtctccactcccaaacccttaaaaaccccagccccaaactcctcagggagatggatttgacgtttcctcccatttcctccttcggtggccctacgatgaaacctctttctctgctacaaccctatgcctcggcgtattcactttctggtcccatccagcgatggacccatcgtggttac

SEQ ID NO: 6294 - DNA, 672 bp, synthetic construct
  misc_feature 1..672: note = Synthetic polypeptide
  source 1..672: mol_type = other DNA
agataatagtagcagaatttcacaaaaaaatcaaagaggcatttgaagtctttgaccatgagtcgaataatacagtggatgtgagagagattggaacaattatcaggtcattaggatgctgtcctacggaaggagagctgcatgatctgattgcagaggtagaggaagaagaacccactggatacattcgattcgaaaaatttcttccggtgatgacagaaatactactagaaagaaaatacagaccaattccagaagatgtccttcttcgagcttttgaggttttagattcagctaaacgtgggtttcttactaaggacgagctgatcaagtatatgactgaagaagatcctgaattccagcaaaacagccgacaccaaccagtttgaagacccccacagaggaatgtgatcagcatgaaaatacagcttcgtctccctctcccatgactccaccctgcacacttcgaccaatcaaccatctccacactccagtctccactcccaaacccttaaaaaccccagccccaaactcctcagggagatggatttgacgtttcctcccatttcctccttcggtggccctacgatgaaacctctttctctgctacaaccctatgcctcggcgtattcactttctggtcccatccagcgatggacccatcgtggttac

SEQ ID NO: 6295 - DNA, 420 bp, synthetic construct
  misc_feature 1..420: note = Synthetic polypeptide
  source 1..420: mol_type = other DNA
cagaagatgtccttcttcgagcttttgaggttttagattcagctaaacgtgggtttcttactaaggacgagctgatcaagtatatgactgaagaagatcctgaattccagcaaaacagccgacaccaaccagtttgaagacccccacagaggaatgtgatcagcatgaaaatacagcttcgtctccctctcccatgactccaccctgcacacttcgaccaatcaaccatctccacactccagtctccactcccaaacccttaaaaaccccagccccaaactcctcagggagatggatttgacgtttcctcccatttcctccttcggtggccctacgatgaaacctctttctctgctacaaccctatgcctcggcgtattcactttctggtcccatccagcgatggacccatcgtggttac

SEQ ID NO: 6296 - DNA, 1081 bp, synthetic construct; identical to SEQ ID NO: 986
  misc_feature 1..1081: note = Synthetic polypeptide
  source 1..1081: mol_type = other DNA

SEQ ID NO: 6297 - DNA, 1054 bp, synthetic construct; identical to SEQ ID NO: 987
  misc_feature 1..1054: note = Synthetic polypeptide
  source 1..1054: mol_type = other DNA

SEQ ID NO: 6298 - DNA, 1689 bp, synthetic construct; identical to SEQ ID NO: 964
  misc_feature 1..1689: note = Synthetic polypeptide
  source 1..1689: mol_type = other DNA

SEQ ID NO: 6299 - DNA, 1671 bp, synthetic construct; identical to SEQ ID NO: 965
  misc_feature 1..1671: note = Synthetic polypeptide
  source 1..1671: mol_type = other DNA

SEQ ID NO: 6300 - DNA, 650 bp, synthetic construct; identical to SEQ ID NO: 966
  misc_feature 1..650: note = Synthetic polypeptide
  source 1..650: mol_type = other DNA

SEQ ID NO: 6301 - DNA, 798 bp, synthetic construct; identical to SEQ ID NO: 3839
  misc_feature 1..798: note = Synthetic polypeptide
  source 1..798: mol_type = other DNA

SEQ ID NO: 6302 - DNA, 573 bp, synthetic construct; identical to SEQ ID NO: 1369
  misc_feature 1..573: note = Synthetic polypeptide
  source 1..573: mol_type = other DNA

SEQ ID NO: 6303 - DNA, 416 bp, synthetic construct; identical to SEQ ID NO: 1370
  misc_feature 1..416: note = Synthetic polypeptide
  source 1..416: mol_type = other DNA

SEQ ID NO: 6304 - DNA, 77 bp, synthetic construct; identical to SEQ ID NO: 1778
  misc_feature 1..77: note = Synthetic polypeptide
  source 1..77: mol_type = other DNA

SEQ ID NO: 6305 - DNA, 2079 bp, synthetic construct
  misc_feature 1..2079: note = Synthetic polypeptide
  source 1..2079: mol_type = other DNA
atgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaacacgtcagcctcatcgacatatccagcattccttcctatgactggatgagaagagtcacacagaggaaaaaagtatccaagaagggaaaagcctgtctgctgtttgaccatctggagcccattgaattggctgagcacctcacttttctggagcataaatcttttagaaggatctcattcactgattaccaaagctatgtcatccatggctgcctggagaataatccaaccttggaaagatcgattgctttatttaatggaatctctaagtgggtccagttgatggttcttagcaaaccaaccccccagcaaagggcagaagtcatcacaaagtttatcaatgttgcaaagaagctccttcagctcaaaaattttaacaccctgatggcagtggtgggaggcctcagtcatagttccatttcacgcctcaaagagacccattctcatctttcttcagaagttacaaagaactggaatgaaatgacagagttggtctcctccaacggcaattactgcaattaccgcaaggcctttgccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacgctttccctggacctctatcacactgaagatgatatttacaaactgtcactggtgctggagcctagaaattctaaatcgcagcctacctcccctacgacgcccaacaagcctgtggtacccctggagtgggcattaggggtgatgccaaagccagaccccacggtcatcaacaagcacataaggaaattagtggagtctgtatttagaaactatgatcacgaccatgatgggtacatttcccaagaggactttgaaagtatagctgccaattttcccttcttggattccttctgtgttctggacaaagatcaggatggcctaattagtaaagatgaaatgatggcttacttcctgagagctaaatcccaactacactgtaaaatgggaccaggatttatccataattttcaggagatgacctatctcaagccaaccttctgcgaacactgtgcgggatttctctggggcataatcaagcaaggatacaaatgcaaagactgtggagccaattgtcacaaacagtgcaaagacctcctggttctggcctgcaggagatttgcccgggcgccctccttgagcagtggtcatgggtcactgcctggaagcccctcgctgcccccagcgcaggatgaggtgtttgagttccctggagtcactgctggacacagggatttagacagcagagccatcacactggttacaggctcttctcgcaagatctctgtgaggctacagagggccaccaccagccaggccacccagactgaacctgtctggtcagaggctggctggggggactcggggtcccacaccttccctaaaatgaaatccaagttccatgacaaagcagcaaaggacaaaggctttgccaaatgggaaaatgagaagcccagggtgcatgctggtgtggatgttgtagaccggggcacggagtttgaacttgaccaggatgaaggagaagagaccagacaggatggtgaggaacttcccacagat

SEQ ID NO: 6306 - DNA, 2076 bp, synthetic construct
  misc_feature 1..2076: note = Synthetic polypeptide
  source 1..2076: mol_type = other DNA
atgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaacacgtcagcctcatcgacatatccagcattccttcctatgactggatgagaagagtcacacagaggaaaaaagtatccaagaagggaaaagcctgtctgctgtttgaccatctggagcccattgaattggctgagcacctcacttttctggagcataaatcttttagaaggatctcattcactgattaccaaagctatgtcatccatggctgcctggagaataatccaaccttggaaagatcgattgctttatttaatggaatctctaagtgggtccagttgatggttcttagcaaaccaaccccccagcaaagggcagaagtcatcacaaagtttatcaatgttgcaaagaagctccttcagctcaaaaattttaacaccctgatggcagtggtgggaggcctcagtcatagttccatttcacgcctcaaagagacccattctcatctttcttcagaagttacaaagaactggaatgaaatgacagagttggtctcctccaacggcaattactgcaattaccgcaaggcctttgccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacgctttccctggacctctatcacactgaagatgatatttacaaactgtcactggtgctggagcctagaaattctaaatcgcctacctcccctacgacgcccaacaagcctgtggtacccctggagtgggcattaggggtgatgccaaagccagaccccacggtcatcaacaagcacataaggaaattagtggagtctgtatttagaaactatgatcacgaccatgatgggtacatttcccaagaggactttgaaagtatagctgccaattttcccttcttggattccttctgtgttctggacaaagatcaggatggcctaattagtaaagatgaaatgatggcttacttcctgagagctaaatcccaactacactgtaaaatgggaccaggatttatccataattttcaggagatgacctatctcaagccaaccttctgcgaacactgtgcgggatttctctggggcataatcaagcaaggatacaaatgcaaagactgtggagccaattgtcacaaacagtgcaaagacctcctggttctggcctgcaggagatttgcccgggcgccctccttgagcagtggtcatgggtcactgcctggaagcccctcgctgcccccagcgcaggatgaggtgtttgagttccctggagtcactgctggacacagggatttagacagcagagccatcacactggttacaggctcttctcgcaagatctctgtgaggctacagagggccaccaccagccaggccacccagactgaacctgtctggtcagaggctggctggggggactcggggtcccacaccttccctaaaatgaaatccaagttccatgacaaagcagcaaaggacaaaggctttgccaaatgggaaaatgagaagcccagggtgcatgctggtgtggatgttgtagaccggggcacggagtttgaacttgaccaggatgaaggagaagagaccagacaggatggtgaggaacttcccacagat

SEQ ID NO: 6307 - DNA, 2101 bp, synthetic construct
  misc_feature 1..2101: note = Synthetic polypeptide
  source 1..2101: mol_type = other DNA
atgagtgccgaggaggatgccaggtggctccggtgggtgactcagcagtttaagaccattgcaggagaagatggggagatcagcctgcaagaattcaaagcagctctgcatgtgaaagagtccttctttgcagagcgattctttgccctatttgactccgatagaagtggcaccatcaccctccaggagctgcaggaggcactgaccctgctcatccatggcagccccatggacaaactcaaattcctcttccaggtgtatgacatcgatggcagtggctccattgacccggatgagctgcgcactgtgctgcagtcgtgtctgcgcgagagcgccatctcgctgcctgacgagaagctggaccagctgacgctggcgctcttcgaatcggccgacgcggacggcaacggggccatcaccttcgaggagctccgggacgagctgcagcgcttccccggagtcatggagaacctgaccatcagcgctgcccactggctgacggcccccgccccccgcccacgcccgcgccggccgcgccagctgacccgcgcctactggcacaaccaccgcagccagctgttctgcctggccacctatgcaggcctccacgtgctgctcttcgggctggcggccagcgcgcaccgggacctcggcgccagcgtcatggtggccaagggctgcggccagtgcctcaacttcgactgcagcttcatcgcggtgctgatgctcagacgctgcctcacctggctgcgggccacgtggctggctcaagtcctaccactggaccagaacatccagttccaccagcttatgggctacgtggtagtggggctgtccctcgtgcacaccgtggctcacactgtgaactttgtactccaggctcaggcggaggccagccctttccagttctgggagctgctgctcaccacgaggcctggcattggctgggtacacggttcggcctccccgacaggtgtcgctctgctgctgctgctcctcctcatgttcatctgctccagttcctgcatccgcaggagtggccactttgaggtgttctattggactcacctgtcctacctcctcgtgtggcttctgctcatctttcatgggcccaacttctggaagtggctgctggtgcctggaatcttgtttttcctggagaaggccatcggactggcagtgtcccgcatggcagccgtgtgcatcatggaagtcaacctcctcccctccaaggtcactcatctcctcatcaagcggccccctttttttcactatagacctggtgactacttgtatctgaacatccccaccattgctcgctatgagtggcaccccttcaccatcagcagtgctcctgagcagaaagacactatctggctgcacattcggtcccaaggccagtggacaaacaggctgtatgagtccttcaaggcatcagacccactgggccgtggttctaagaggctgtcgaggagtgtgacaatgagaaagagtcaaaggtcgtccaagggctctgagatacttttggagaaacacaaattctgtaacatcaagtgctacatcgatgggccttatgggacccccacccgcaggatctttgcctctgagcatgccgtgctcatcggggcaggcatcggcatcaccccctttgcttccattctgcagagtatcatgtacaggcaccagaaaagaaagcatacttgccccagctgccagcactcctggatcgaaggtgtccaagacaacatgaagctccataaggtggactttatctggatcaacagagaccagcggtctttcgagtggtttgtgagcctgctgactaaactggagatggaccaggccgaggaggctcaatacggccgcttcctggagctgcatatgtacatgacatctgcactgggcaagaatgacatgaaggccattggcctgcagatggcccttgacctcctggccaacaaggagaagaaagactccatcacggggctgcagacgcgcacccagcctgggcggcctgactggagcaaggacactgtgcagcttcgcacctccaagcctttgcttctgcatcgcctgacacttggagcacccttctccactt

SEQ ID NO: 6308 - DNA, 2185 bp, synthetic construct
  misc_feature 1..2185: note = Synthetic polypeptide
  source 1..2185: mol_type = other DNA
atgagtgccgaggaggatgccaggtggctccggtgggtgactcagcagtttaagaccattgcaggagaagatggggagatcagcctgcaagaattcaaagcagctctgcatgtgaaagagtccttctttgcagagcgattctttgccctatttgactccgatagaagtggcaccatcaccctccaggagctgcaggaggcactgaccctgctcatccatggcagccccatggacaaactcaaattcctcttccaggtgtatgacatcgatgtgtgtgcacggcagggggcgtctgcaggtacagagtggggtgctggggcaggcccgcactgggcttcatccccactcgggacaggcagtggctccattgacccggatgagctgcgcactgtgctgcagtcgtgtctgcgcgagagcgccatctcgctgcctgacgagaagctggaccagctgacgctggcgctcttcgaatcggccgacgcggacggcaacggggccatcaccttcgaggagctccgggacgagctgcagcgcttccccggagtcatggagaacctgaccatcagcgctgcccactggctgacggcccccgccccccgcccacgcccgcgccggccgcgccagctgacccgcgcctactggcacaaccaccgcagccagctgttctgcctggccacctatgcaggcctccacgtgctgctcttcgggctggcggccagcgcgcaccgggacctcggcgccagcgtcatggtggccaagggctgcggccagtgcctcaacttcgactgcagcttcatcgcggtgctgatgctcagacgctgcctcacctggctgcgggccacgtggctggctcaagtcctaccactggaccagaacatccagttccaccagcttatgggctacgtggtagtggggctgtccctcgtgcacaccgtggctcacactgtgaactttgtactccaggctcaggcggaggccagccctttccagttctgggagctgctgctcaccacgaggcctggcattggctgggtacacggttcggcctccccgacaggtgtcgctctgctgctgctgctcctcctcatgttcatctgctccagttcctgcatccgcaggagtggccactttgaggtgttctattggactcacctgtcctacctcctcgtgtggcttctgctcatctttcatgggcccaacttctggaagtggctgctggtgcctggaatcttgtttttcctggagaaggccatcggactggcagtgtcccgcatggcagccgtgtgcatcatggaagtcaacctcctcccctccaaggtcactcatctcctcatcaagcggccccctttttttcactatagacctggtgactacttgtatctgaacatccccaccattgctcgctatgagtggcaccccttcaccatcagcagtgctcctgagcagaaagacactatctggctgcacattcggtcccaaggccagtggacaaacaggctgtatgagtccttcaaggcatcagacccactgggccgtggttctaagaggctgtcgaggagtgtgacaatgagaaagagtcaaaggtcgtccaagggctctgagatacttttggagaaacacaaattctgtaacatcaagtgctacatcgatgggccttatgggacccccacccgcaggatctttgcctctgagcatgccgtgctcatcggggcaggcatcggcatcaccccctttgcttccattctgcagagtatcatgtacaggcaccagaaaagaaagcatacttgccccagctgccagcactcctggatcgaaggtgtccaagacaacatgaagctccataaggtggactttatctggatcaacagagaccagcggtctttcgagtggtttgtgagcctgctgactaaactggagatggaccaggccgaggaggctcaatacggccgcttcctggagctgcatatgtacatgacatctgcactgggcaagaatgacatgaaggccattggcctgcagatggcccttgacctcctggccaacaaggagaagaaagactccatcacggggctgcagacgcgcacccagcctgggcggcctgactggagcaaggacactgtgcagcttcgcacctccaagcctttgcttctgcatcgcctgacacttggagcacccttctccactt

SEQ ID NO: 6309 - DNA, 2134 bp, synthetic construct
  misc_feature 1..2134: note = Synthetic polypeptide
  source 1..2134: mol_type = other DNA
atggccttcgtctgtgccggcttatccgacaccatgagtgccgaggaggatgccaggtggctccggtgggtgactcagcagtttaagaccattgcaggagaagatggggagatcagcctgcaagaattcaaagcagctctgcatgtgaaagagtccttctttgcagagcgattctttgccctatttgactccgatagaagtggcaccatcaccctccaggagctgcaggaggcactgaccctgctcatccatggcagccccatggacaaactcaaattcctcttccaggtgtatgacatcgatggcagtggctccattgacccggatgagctgcgcactgtgctgcagtcgtgtctgcgcgagagcgccatctcgctgcctgacgagaagctggaccagctgacgctggcgctcttcgaatcggccgacgcggacggcaacggggccatcaccttcgaggagctccgggacgagctgcagcgcttccccggagtcatggagaacctgaccatcagcgctgcccactggctgacggcccccgccccccgcccacgcccgcgccggccgcgccagctgacccgcgcctactggcacaaccaccgcagccagctgttctgcctggccacctatgcaggcctccacgtgctgctcttcgggctggcggccagcgcgcaccgggacctcggcgccagcgtcatggtggccaagggctgcggccagtgcctcaacttcgactgcagcttcatcgcggtgctgatgctcagacgctgcctcacctggctgcgggccacgtggctggctcaagtcctaccactggaccagaacatccagttccaccagcttatgggctacgtggtagtggggctgtccctcgtgcacaccgtggctcacactgtgaactttgtactccaggctcaggcggaggccagccctttccagttctgggagctgctgctcaccacgaggcctggcattggctgggtacacggttcggcctccccgacaggtgtcgctctgctgctgctgctcctcctcatgttcatctgctccagttcctgcatccgcaggagtggccactttgaggtgttctattggactcacctgtcctacctcctcgtgtggcttctgctcatctttcatgggcccaacttctggaagtggctgctggtgcctggaatcttgtttttcctggagaaggccatcggactggcagtgtcccgcatggcagccgtgtgcatcatggaagtcaacctcctcccctccaaggtcactcatctcctcatcaagcggccccctttttttcactatagacctggtgactacttgtatctgaacatccccaccattgctcgctatgagtggcaccccttcaccatcagcagtgctcctgagcagaaagacactatctggctgcacattcggtcccaaggccagtggacaaacaggctgtatgagtccttcaaggcatcagacccactgggccgtggttctaagaggctgtcgaggagtgtgacaatgagaaagagtcaaaggtcgtccaagggctctgagatacttttggagaaacacaaattctgtaacatcaagtgctacatcgatgggccttatgggacccccacccgcaggatctttgcctctgagcatgccgtgctcatcggggcaggcatcggcatcaccccctttgcttccattctgcagagtatcatgtacaggcaccagaaaagaaagcatacttgccccagctgccagcactcctggatcgaaggtgtccaagacaacatgaagctccataaggtggactttatctggatcaacagagaccagcggtctttcgagtggtttgtgagcctgctgactaaactggagatggaccaggccgaggaggctcaatacggccgcttcctggagctgcatatgtacatgacatctgcactgggcaagaatgacatgaaggccattggcctgcagatggcccttgacctcctggccaacaaggagaagaaagactccatcacggggctgcagacgcgcacccagcctgggcggcctgactggagcaaggacactgtgcagcttcgcacctccaagcctttgcttctgcatcgcctgacacttggagcacccttctccactt

SEQ ID NO: 6310 - DNA, 2239 bp, synthetic construct
  misc_feature 1..2239: note = Synthetic polypeptide
  source 1..2239: mol_type = other DNA
atgaacacatctggagacccagcccagacgggccctgaaggctgtagaggcaccatgagtgccgaggaggatgccaggtggctccggtgggtgactcagcagtttaagaccattgcaggagaagatggggagatcagcctgcaagaattcaaagcagctctgcatgtgaaagagtccttctttgcagagcgattctttgccctatttgactccgatagaagtggcaccatcaccctccaggagctgcaggaggcactgaccctgctcatccatggcagccccatggacaaactcaaattcctcttccaggtgtatgacatcgatgtgtgtgcacggcagggggcgtctgcaggtacagagtggggtgctggggcaggcccgcactgggcttcatccccactcgggacaggcagtggctccattgacccggatgagctgcgcactgtgctgcagtcgtgtctgcgcgagagcgccatctcgctgcctgacgagaagctggaccagctgacgctggcgctcttcgaatcggccgacgcggacggcaacggggccatcaccttcgaggagctccgggacgagctgcagcgcttccccggagtcatggagaacctgaccatcagcgctgcccactggctgacggcccccgccccccgcccacgcccgcgccggccgcgccagctgacccgcgcctactggcacaaccaccgcagccagctgttctgcctggccacctatgcaggcctccacgtgctgctcttcgggctggcggccagcgcgcaccgggacctcggcgccagcgtcatggtggccaagggctgcggccagtgcctcaacttcgactgcagcttcatcgcggtgctgatgctcagacgctgcctcacctggctgcgggccacgtggctggctcaagtcctaccactggaccagaacatccagttccaccagcttatgggctacgtggtagtggggctgtccctcgtgcacaccgtggctcacactgtgaactttgtactccaggctcaggcggaggccagccctttccagttctgggagctgctgctcaccacgaggcctggcattggctgggtacacggttcggcctccccgacaggtgtcgctctgctgctgctgctcctcctcatgttcatctgctccagttcctgcatccgcaggagtggccactttgaggtgttctattggactcacctgtcctacctcctcgtgtggcttctgctcatctttcatgggcccaacttctggaagtggctgctggtgcctggaatcttgtttttcctggagaaggccatcggactggcagtgtcccgcatggcagccgtgtgcatcatggaagtcaacctcctcccctccaaggtcactcatctcctcatcaagcggccccctttttttcactatagacctggtgactacttgtatctgaacatccccaccattgctcgctatgagtggcaccccttcaccatcagcagtgctcctgagcagaaagacactatctggctgcacattcggtcccaaggccagtggacaaacaggctgtatgagtccttcaaggcatcagacccactgggccgtggttctaagaggctgtcgaggagtgtgacaatgagaaagagtcaaaggtcgtccaagggctctgagatacttttggagaaacacaaattctgtaacatcaagtgctacatcgatgggccttatgggacccccacccgcaggatctttgcctctgagcatgccgtgctcatcggggcaggcatcggcatcaccccctttgcttccattctgcagagtatcatgtacaggcaccagaaaagaaagcatacttgccccagctgccagcactcctggatcgaaggtgtccaagacaacatgaagctccataaggtggactttatctggatcaacagagaccagcggtctttcgagtggtttgtgagcctgctgactaaactggagatggaccaggccgaggaggctcaatacggccgcttcctggagctgcatatgtacatgacatctgcactgggcaagaatgacatgaaggccattggcctgcagatggcccttgacctcctggccaacaaggagaagaaagactccatcacggggctgcagacgcgcacccagcctgggcggcctgactggagcaaggacactgtgcagcttcgcacctccaagcctttgcttctgcatcgcctgacacttggagcacccttctccactt

SEQ ID NO: 6311 - DNA, 2155 bp, synthetic construct
  misc_feature 1..2155: note = Synthetic polypeptide
  source 1..2155: mol_type = other DNA
atgaacacatctggagacccagcccagacgggccctgaaggctgtagaggcaccatgagtgccgaggaggatgccaggtggctccggtgggtgactcagcagtttaagaccattgcaggagaagatggggagatcagcctgcaagaattcaaagcagctctgcatgtgaaagagtccttctttgcagagcgattctttgccctatttgactccgatagaagtggcaccatcaccctccaggagctgcaggaggcactgaccctgctcatccatggcagccccatggacaaactcaaattcctcttccaggtgtatgacatcgatggcagtggctccattgacccggatgagctgcgcactgtgctgcagtcgtgtctgcgcgagagcgccatctcgctgcctgacgagaagctggaccagctgacgctggcgctcttcgaatcggccgacgcggacggcaacggggccatcaccttcgaggagctccgggacgagctgcagcgcttccccggagtcatggagaacctgaccatcagcgctgcccactggctgacggcccccgccccccgcccacgcccgcgccggccgcgccagctgacccgcgcctactggcacaaccaccgcagccagctgttctgcctggccacctatgcaggcctccacgtgctgctcttcgggctggcggccagcgcgcaccgggacctcggcgccagcgtcatggtggccaagggctgcggccagtgcctcaacttcgactgcagcttcatcgcggtgctgatgctcagacgctgcctcacctggctgcgggccacgtggctggctcaagtcctaccactggaccagaacatccagttccaccagcttatgggctacgtggtagtggggctgtccctcgtgcacaccgtggctcacactgtgaactttgtactccaggctcaggcggaggccagccctttccagttctgggagctgctgctcaccacgaggcctggcattggctgggtacacggttcggcctccccgacaggtgtcgctctgctgctgctgctcctcctcatgttcatctgctccagttcctgcatccgcaggagtggccactttgaggtgttctattggactcacctgtcctacctcctcgtgtggcttctgctcatctttcatgggcccaacttctggaagtggctgctggtgcctggaatcttgtttttcctggagaaggccatcggactggcagtgtcccgcatggcagccgtgtgcatcatggaagtcaacctcctcccctccaaggtcactcatctcctcatcaagcggccccctttttttcactatagacctggtgactacttgtatctgaacatccccaccattgctcgctatgagtggcaccccttcaccatcagcagtgctcctgagcagaaagacactatctggctgcacattcggtcccaaggccagtggacaaacaggctgtatgagtccttcaaggcatcagacccactgggccgtggttctaagaggctgtcgaggagtgtgacaatgagaaagagtcaaaggtcgtccaagggctctgagatacttttggagaaacacaaattctgtaacatcaagtgctacatcgatgggccttatgggacccccacccgcaggatctttgcctctgagcatgccgtgctcatcggggcaggcatcggcatcaccccctttgcttccattctgcagagtatcatgtacaggcaccagaaaagaaagcatacttgccccagctgccagcactcctggatcgaaggtgtccaagacaacatgaagctccataaggtggactttatctggatcaacagagaccagcggtctttcgagtggtttgtgagcctgctgactaaactggagatggaccaggccgaggaggctcaatacggccgcttcctggagctgcatatgtacatgacatctgcactgggcaagaatgacatgaaggccattggcctgcagatggcccttgacctcctggccaacaaggagaagaaagactccatcacggggctgcagacgcgcacccagcctgggcggcctgactggagcaaggacactgtgcagcttcgcacctccaagcctttgcttctgcatcgcctgacacttggagcacccttctccactt

SEQ ID NO: 6312 - DNA, 1705 bp, synthetic construct; identical to SEQ ID NO: 1155
  misc_feature 1..1705: note = Synthetic polypeptide
  source 1..1705: mol_type = other DNA

SEQ ID NO: 6313 - DNA, 1356 bp, synthetic construct; identical to SEQ ID NO: 5183
  misc_feature 1..1356: note = Synthetic polypeptide
  source 1..1356: mol_type = other DNA

SEQ ID NO: 6314 - DNA, 1157 bp, synthetic construct
  misc_feature 1..1157: note = Synthetic polypeptide
  source 1..1157: mol_type = other DNA
atggctgcgtcttcgagtggtgagaaggagaaggagcggctgggaggcggtttgggagtggcgggtggtaacagcacacgagagcggctgctgtctgcgcttgaggacttggaggtcctgtctagggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtaactttgcattctaatggaccaactggtaccacccaaatcggtaagccacacaaagaaactgactcaagtggtcctgtgaaccccccatcgaggaactgactcagcacaagaagacagttttgacatccgtatggttttatccccaacccaacaaagcagcatttctcattccctagccccttgcttgtcaaaccatccttgaaaaaccctagcctctgaattctctatgggtaggatttaagaattatctcccgtcctcctcatgcagctgccctgtgattattaaactctttctctgctacaactcctactgtctcagggtactggctttttctgggtggcaggcaagaagaaccca

SEQ ID NO: 6315 - DNA, 1019 bp, synthetic construct
  misc_feature 1..1019: note = Synthetic polypeptide
  source 1..1019: mol_type = other DNA
atgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtaactttgcattctaatggaccaactggtaccacccaaatcggtaagccacacaaagaaactgactcaagtggtcctgtgaaccccccatcgaggaactgactcagcacaagaagacagttttgacatccgtatggttttatccccaacccaacaaagcagcatttctcattccctagccccttgcttgtcaaaccatccttgaaaaaccctagcctctgaattctctatgggtaggatttaagaattatctcccgtcctcctcatgcagctgccctgtgattattaaactctttctctgctacaactcctactgtctcagggtactggctttttctgggtggcaggcaagaagaaccca

SEQ ID NO: 6316 - DNA, 1167 bp, synthetic construct
  misc_feature 1..1167: note = Synthetic polypeptide
  source 1..1167: mol_type = other DNA
gagtctagcttatggttaaaaacctatgtgtgatgtttcagacctgaccataaacaattacagactttacctaggaggccacatggggaaaagctgccctccctacaccagacttggcgtactgccaatgcattacagtttctaaagggagttgcagtcaaggactcagggccccctgttagtcatgctcttgtaacagtatttgcattgagagtcctggcactttcattcttaggtctctctatctgaggccatgggccaaggtcttcttcaggcacctctgccaaggcctgtttatgcaagaaggagtggaaaaaccttgacatttttttccactgtgactcactacccagtacttttccacccttagcccccttcctttgcacccatacccccaagatccatcaaactgctaaagcctttttttccaagctccttcaacagtgaaccaaccctcatgtctgtgtggatccagctgactcttgactagattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccgacatggggagagggagtcttgctgtgttgcccaagctggtcttga

SEQ ID NO: 6317 - DNA, 1266 bp, synthetic construct
  misc_feature 1..1266: note = Synthetic polypeptide
  source 1..1266: mol_type = other DNA
gagtctagcttatggttaaaaacctatgtgtgatgtttcagacctgaccataaacaattacagactttacctaggaggccacatggggaaaagctgccctccctacaccagacttggcgtactgccaatgcattacagtttctaaagggagttgcagtcaaggactcagggccccctgttagtcatgctcttgtaacagtatttgcattgagagtcctggcactttcattcttaggtctctctatctgaggccatgggccaaggtcttcttcaggcacctctgccaaggcctgtttatgcaagaaggagtggaaaaaccttgacatttttttccactgtgactcactacccagtacttttccacccttagcccccttcctttgcacccatacccccaagatccatcaaactgctaaagcctttttttccaagctccttcaacagtgaaccaaccctcatgtctgtgtggatccagctgactcttgactagattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactga

SEQ ID NO: 6318 - DNA, 406 bp, synthetic construct
  misc_feature 1..406: note = Synthetic polypeptide
  source 1..406: mol_type = other DNA
gttattgtgtttatttggagaatctccattacaagctcataatgaatcagacatcacagaagaaagacagcctctccatgtcaagcttccagtctgtcaagtccatctctaattcaggcaaggccaggccccagcccggctccttcaacaagcaagattcaaaagctgacgtctcccagaaggcggacctggaagaggagcccctacttcacaacagcaagctggacaaagttcctggggtacaagggcaggccagcccaccacacttaggcagtgcgaagtgctcatccgcgagctgtggaataccaacctcctgcagacccaagagctgcggcacctcaagtccctcctggaagggagccagaggccccaggcagccccggaggaagctagctttcccaggtga

SEQ ID NO: 6319 - DNA, 908 bp, synthetic construct
  misc_feature 1..908: note = Synthetic polypeptide
  source 1..908: mol_type = other DNA
gttattgtgtttatttggagaatctccattacaagctcataatgaatcagacatcacagaagaaagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcgtgggcgtcttgcgggcggtagcgccgacactgtgcgctctcctgcagacagcctctccatgtcaagcttccagtctgtcaagtccatctctaattcaggcaaggccaggccccagcccggctccttcaacaagcaagattcaaaagctgacgtctcccagaaggcggacctggaagaggagcccctacttcacaacagcaagctggacaaagttcctggggtacaagggcaggccagaaaggagaaagcagaggcctctaatgcaggagctgcctgtatggggaacagccagcaccagggcaggcagatgggggcgggggcacaccccccaatgatcctgccccttcccctgcgaaagcccaccacacttaggcagtgcgaagtgctcatccgcgagctgtggaataccaacctcctgcagacccaagagctgcggcacctcaagtccctcctggaagggagccagaggccccaggcagccccggaggaagctagctttcccagggaccaagaagccacgcatttccccaaggtctccaccaagagcctctccaagaaatgcctgagcccacctgtggcggagcgtgccatcctgcccgcactgaagcagaccccgaagaacaactttgccgagaggcagaagaggctgcaggcaatgcagaaacggcgcctgcatcgctcagtgctttga

SEQ ID NO: 6320 - DNA, 710 bp, synthetic construct
  misc_feature 1..710: note = Synthetic polypeptide
  source 1..710: mol_type = other DNA
gttattgtgtttatttggagaatctccattacaagctcataatgaatcagacatcacagaagaaagacagcctctccatgtcaagcttccagtctgtcaagtccatctctaattcaggcaaggccaggccccagcccggctccttcaacaagcaagattcaaaagctgacgtctcccagaaggcggacctggaagaggagcccctacttcacaacagcaagctggacaaagttcctggggtacaagggcaggccagaaaggagaaagcagaggcctctaatgcaggagctgcctgtatggggaacagccagcaccagggcaggcagatgggggcgggggcacaccccccaatgatcctgccccttcccctgcgaaagcccaccacacttaggcagtgcgaagtgctcatccgcgagctgtggaataccaacctcctgcagacccaagagctgcggcacctcaagtccctcctggaagggagccagaggccccaggcagccccggaggaagctagctttcccagggaccaagaagccacgcatttccccaaggtctccaccaagagcctctccaagaaatgcctgagcccacctgtggcggagcgtgccatcctgcccgcactgaagcagaccccgaagaacaactttgccgagaggcagaagaggctgcaggcaatgcagaaacggcgcctgcatcgctcagtgctttga

SEQ ID NO: 6321 - DNA, 560 bp, synthetic construct
  misc_feature 1..560: note = Synthetic polypeptide
  source 1..560: mol_type = other DNA
tgatgtggtttgactgtgtccccactcacatctcatcttgaattcccacatgttgtgggagggacccagtgggaggtagttgaatcatgggggcaggcctttcctgtgctgttctggtggtgacgaatgagtctcacgggatctgatgattatataagggggagtttccctgcacaagctctcatctggtctgctgccatgtgaggtgtgcctttcaccttctgccatgattgtgaagcctccccaccacatggaacggtgacagattgactgggatcccctcgcacatcctcaacagctccccatcagaccggcagattaaccagctggcccagaggctgggccctgagtgggagcccatggtgctgtctctgggactgtcccagacggatatctaccgctgtaaggccaaccacccccacaacgtgcagtcgcaggtggtggaggccttcatccgttggcggcagcgcttcgggaagcaggccaccttccagagcctgcacaacgggctgcgggctgtggaggtggacccctcgctgctcctgcacatgttggagtga

SEQ ID NO: 6322 - DNA, 560 bp, synthetic construct
  misc_feature 1..560: note = Synthetic polypeptide
  source 1..560: mol_type = other DNA
acttggagttaggatccccaggttctagtcctgagtctggactctggatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctag

SEQ ID NO: 6323 - DNA, 138 bp, synthetic construct
  misc_feature 1..138: note = Synthetic polypeptide
  source 1..138: mol_type = other DNA
gcctcagattccttatatgtaagatcacggttgggctgccaaatctgtttgacaaaatctatggacaatatgactgttcgagtgcctgaaacagtggctgatgccagacaatccattgatgtgggcaagacctcctga

SEQ ID NO: 6324 - DNA, 171 bp, synthetic construct
  misc_feature 1..171: note = Synthetic polypeptide
  source 1..171: mol_type = other DNA
ggccaggcatggtgtctcacgcctggaatcccagcgctttgggaggctgagggtcctgaggacaccgtgagccagccaggcctggccgctgggcctgaccggccccccagcccctacaccccgcttctcccggactctcccagcggacagccccccagccccacagcctga

SEQ ID NO: 6325 - DNA, 59 bp, synthetic construct
  misc_feature 1..59: note = Synthetic polypeptide
  source 1..59: mol_type = other DNA
ggccaggcatggtgtctcacgcctggaatcccagcgctttgggaggctgagggtcctga

SEQ ID NO: 6326 - DNA, 231 bp, synthetic construct
  misc_feature 1..231: note = Synthetic polypeptide
  source 1..231: mol_type = other DNA
acgaggctttgaaagcctcggacaggacaggtgcgtcctgtctaactcgccagtggccctgggcgagcttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataa

SEQ ID NO: 6327 - DNA, 147 bp, synthetic construct
  misc_feature 1..147: note = Synthetic polypeptide
  source 1..147: mol_type = other DNA
aagacagacaataacaagtgttgctgacggtgtggagaaattggaaccctcatacattgcaggaggccagatgctccagtgcctgatggcgaaagtgagaaaactgtagaagaaagttcagatagcgaatcttcttttagtgattaa

SEQ ID NO: 6328 - DNA, 1651 bp, synthetic construct
  misc_feature 1..1651: note = Synthetic polypeptide
  source 1..1651: mol_type = other DNA
caggacagttttctgggtggccttggcctcctttcctcacttgaagttcttaagaataactataaaatgtgctgggaatgcaacattctgagataaaggaggagctggccagaacagcctactctctgtgccagtcttcccccacccacaaaacaggatgtccttcagtgctttagcctagcacgtcctttgatctcagaacatcaaacccaggtggactgctttctggggttcttcagctgctgtgcaagtgtggcatatgaagacttcatttgccctgggcagctttcctgagccttacgggaccagttcacaatgaatcctaggcttctgttgtcccttgttacctatcttctcagctgtttcagttccgggaatgacagatacctcagtcttggaccaatggaaagcaagtttctttgtggaggatttccttgagaaaaaaacaattacaagaatggtgacccagattaattgtgaatttgaggaagttgttccaagttcaaatccagactcccaaattgaagtagaggaggtcagtttatacacccacatggactacaatgaagtctttacccctgtcagttgtttagaaaaatgttcagcacttcaaaaccagaaccaagatttatttattgatgataaaggaatactttttgtaagtagtagaaaacacctaccaactttgcctactctcttgagtagactaaaactgtttttggtaaaggatcctcttttagatttcaaaggacagatcttcacagaagctaatttttccagggaatgtttctctcttcaagaaactttggaagcttttgtgaaagaagatttttgtatggataaagtgaacttttgtcaagagaaactagaagatacaatatgtttaaatgagccgtcaagttttcttattgagtatgaattcttaatacctccaagcctcaaaccagaaattgatattccatcactctcagaactgaaggagttattaaacccagtgccagaaataataaactatgtagatgaaaaggaaaagctttttgaaagagatcttactaacaagcatggaattgaggatatcggggatataaaattcagctccacagagattttgaccattcaaagccagagtgaaccagaagagtgcagtaaaccaggagagttagaaatgccactaactcctctattcctaacatgccaacattcttcagtgaattcattacgtacagaacttcagacatttccattatctccggtttgtaaaattaatttgcttactgctgaagaatcagctaatgaatactacatgatgtggcaattagaaagatgtagaagccctttgaacccatttttgcttacagtgccaagaattcaagagccccacagccaatattcagttacagatttgaaaaagatattttctgttaaagaagaaagccttgtgattaatctggaaaaggcagagtggtggaaacaagcaggactaaatctgaaaatgatggaaacattggaacatctgaatacatatttatgtcatgataatttgtcttctaatgacactaaaattgagatatttttgcctacgaaagtgcttcaattagaatgtaagtacatcacagtaaatattagttatgtaaacattttcagaatgtga

SEQ ID NO: 6329 - DNA, 376 bp, synthetic construct
  misc_feature 1..376: note = Synthetic polypeptide
  source 1..376: mol_type = other DNA
caggtgggcagtaagtgggtgggtcataggaagaaaagtgatcttcagtcaggagacttgggttctgggctctgtctgatgactggctctgtgatgtgagccaggaggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctccaagcagaagaagaagaagacaaagaagccgaaggagccacagccggaacagccacagccaagtacaagtgcaaattaa

SEQ ID NO: 6330 - DNA, 1214 bp, synthetic construct
  misc_feature 1..1214: note = Synthetic polypeptide
  source 1..1214: mol_type = other DNA
gcaaaggcagtcaggtttatgatcaggactgcccttatctgtaaagctgctaacccccgagcctggaagggaaaagattaacaccagctgccaggcttttggttgtaccatacaacaagaaggcttggacaaggagaacactttttctggattggttccattgtcgatttgtccctgaagttaagtagtatcttgccagtaaggggactgccttttaaagttcttttgatactggagaatgcccgaggccaccccaaactccatgagttcaacaccgaagacattgaagtgatctacttgcccccaaacacacatctctaattcagcctctagatcagggtgtcataaggacctttaaggctcgttacaaacagtactctatagaaaggattgtcaaatgtatggaaaagaaccttgacagaacatgaaagtctgaaagaattacaccatcaatgatgccatcattgttatagaaaaagctgtgaaagccatcaagcccaggacaataaattcctgctagagaaaactgtgtccagatgtgcatgacttcacaggctttacgacagccaatcaaggaaatcatgaaaaagattgtggatctggcacaaaaaaaaaaaaaaaaaaaaaaaatggtgcatgaaggatttcaagataggaatcttggagaaattcaagaggtgatagacatcacaccggaggaattaacagaagatgacttgatggagatgagtacttccaaaccagcgccagacaatgaggaagattacataaaagaagcagtgccagaaaataaattgacatttgttccaaaggttccaattattcaagactgcctttggcttcttttacaacatggatgattctatgttatgggcactgaaactaaaagaaactgtggaaggattggtaccttagagaaatgaaaaagcaaaaacatcagaaattatggtgtatttctgtaaagttagtgacactgagtgtgcccacctctcttgcctcctctttaacctcccctacctgtttcatctctaccacccctgagacagcaagaccaacccctccacttcctcctctacttcagcctactcaacgtggagatgacaaagatgaagacctttatgatgatccacttccatttaatgaataatgctgagctttttataccaccaaagatcaacagaagaacccagtggaagctgagcctgctagactga

SEQ ID NO: 6331 - DNA, 599 bp, synthetic construct
  misc_feature 1..599: note = Synthetic polypeptide
  source 1..599: mol_type = other DNA
gctggacacagtggcacacacctgtaaccccagatatttgggaggctgagtcaggaggattgcttgagcctaggagttcaggtgagtgtctgggtggtgctttatactggaaggaacttgctgtccttgctcaaaaaattgggttctgccctccacgtttggtcactgccaatctcattacaattcaaaacaaggaactggaaagagttatcggtgactgtcgttttgtttctgcaacatttcgcctcttcaaacactctaagacaggaccaaccaagagatgccaagttatttacaatggaggaattacaggacatgaaaaagaactaatgtttgatgccaattttacatttaaggaaggtgaaattgttgaagtggatgaagaaacagcagctatcttgaagaattcaagatttgctcaagattttctgatcagaccaattggagagaagttgccaacatctggaggctgttctgctttggagttaaaggatataatcacagatccatttaagcttgcagaagagtctgacagtatgaagtccagatgtgtccctgatgctgctggaggctgctgtggcacaaagaaaagctgctaa

SEQ ID NO: 6332 - DNA, 672 bp, synthetic construct
  misc_feature 1..672: note = Synthetic polypeptide
  source 1..672: mol_type = other DNA
ttctttgaggccagggtgtgcctgccttggggccttcctaatcgctctccctctcgtgggaatgtccttcctcagataacttgaatggccccttgcctccttcaggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggtga

SEQ ID NO: 6333 - DNA, 693 bp, synthetic construct
  misc_feature 1..693: note = Synthetic polypeptide
  source 1..693: mol_type = other DNA
ttctttgaggccagggtgtgcctgccttggggccttcctaatcgctctccctctcgtgggaatgtccttcctcagataacttgaatggccccttgcctccttcaggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactga

SEQ ID NO: 6334 - DNA, 645 bp, synthetic construct
  misc_feature 1..645: note = Synthetic polypeptide
  source 1..645: mol_type = other DNA
ttctttgaggccagggtgtgcctgccttggggccttcctaatcgctctccctctcgtgggaatgtccttcctcagataacttgaatggccccttgcctccttcaggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccat

SEQ ID NO: 6335 - DNA, 619 bp, synthetic construct
  misc_feature 1..619: note = Synthetic polypeptide
  source 1..619: mol_type = other DNA
ttctttgaggccagggtgtgcctgccttggggccttcctaatcgctctccctctcgtgggaatgtccttcctcagataacttgaatggccccttgcctccttcaggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttga

SEQ ID NO: 6336 - DNA, 522 bp, synthetic construct
  misc_feature 1..522: note = Synthetic polypeptide
  source 1..522: mol_type = other DNA
ttctttgaggccagggtgtgcctgccttggggccttcctaatcgctctccctctcgtgggaatgtccttcctcagataacttgaatggccccttgcctccttcaggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaag

SEQ ID NO: 6337 - DNA, 300 bp, synthetic construct
  misc_feature 1..300: note = Synthetic polypeptide
  source 1..300: mol_type = other DNA
ttctttgaggccagggtgtgcctgccttggggccttcctaatcgctctccctctcgtgggaatgtccttcctcagataacttgaatggccccttgcctccttcaggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgag

SEQ ID NO: 6338 - DNA, 276 bp, synthetic construct
  misc_feature 1..276: note = Synthetic polypeptide
  source 1..276: mol_type = other DNA
ttctttgaggccagggtgtgcctgccttggggccttcctaatcgctctccctctcgtgggaatgtccttcctcagataacttgaatggccccttgcctccttcaggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccg

SEQ ID NO: 6339 - DNA, 237 bp, synthetic construct
  misc_feature 1..237: note = Synthetic polypeptide
  source 1..237: mol_type = other DNA
ttctttgaggccagggtgtgcctgccttggggccttcctaatcgctctccctctcgtgggaatgtccttcctcagataacttgaatggccccttgcctccttcaggaaggagatgacaaaattgagtaccgagcctggaaccccttccgctccaagctagcagcagcaatcctgggtggtgtggaccagatccacatcaaaccgggggctaaggttctctacctcggggctgcctcg

SEQ ID NO: 6340 - DNA, 116 bp, synthetic construct
  misc_feature 1..116: note = Synthetic polypeptide
  source 1..116: mol_type = other DNA
ttctttgaggccagggtgtgcctgccttggggccttcctaatcgctctccctctcgtgggaatgtccttcctcagataacttgaatggccccttgcctccttcaggaaggagatga

SEQ ID NO: 6341 - DNA, 1250 bp, synthetic construct
  misc_feature 1..1250: note = Synthetic polypeptide
  source 1..1250: mol_type = other DNA
gcgtggcatggggcacatcgcccggacttcctgtccctcttgggtttaggaatgggatggtgaggcctccctggcagcttgttaggaggagtaaaccaagcgagccgaccagctcccagcagggtcctggcacacaggaaaaggcccacaaagagaagcccaaccagccagcccccaggccgccccgccagggacccaccaatgaggcacagatggcagccgctgccgccctagcccggctggagcagaagcagtcccgggcctggggccccacatcgcaggacaccatccgaaaccaggtgagaaaggaacttcaagccgaagccaccgtcagcgggagccccgaggccccagggaccaacgtgcacttctccaccgacccagtggccgcctccatcatgaagatctacacgttcaacaaagaccaggaccgggtgaagctgggtgtggacaccattgccaagtacctggacaacatccacctgcaccccgaggaggagaagtaccggaagatcaagctgcagaacaaggtgtttcaggagcgcattaactgcctggaagggacccacgagttttttgaggccattgggttccagaaggtgttgcttcccgcccaggatcaggaggaccccgaggagttctacgtgctgagcgagaccaccttggcccagccccagagcctggagaggcacaaggaacagctgctggctgcggagcccgtgcgcgccaagctggacaggcagcgccgcgtcttccagccctcgcccctggcctcgcagttcgaactgcctggggacttcttcaacctcacagcagaggagatcaagcgggagcagaggctcaggtccgaggcggtggagcggctgagcgtgctgcggaccaaggccatgcgggagaaggaggagcagcgggggctgcgcaagtacaactacacgctgctgcgcgtgcgcctccccgatggctgcctcctgcagggcactttctacgctcgggagcggctgggggcggtgtacgggttcgtccgggaggccctgcagagcgactggctgccttttgagctgctggcctcgggagggcagaagctgtccgaggacgagaacctggccttgaacgagtgcgggctggtgccctctgccctcctgaccttctcgtgggacatggctgtgctggaggacatcaaggccgcgggggccgagccggactccatcctgaaacccgagctcctgtcagccatcgagaagctcttgtga

SEQ ID NO: 6342 - DNA, 1379 bp, synthetic construct
  misc_feature 1..1379: note = Synthetic polypeptide
  source 1..1379: mol_type = other DNA
gcgtggcatggggcacatcgcccggacttcctgtccctcttgggtttaggaatgggatggtgaggcctccctggcagcttgttaggaggagtaaaccaagcgagccgaccagctcccagcagggtcctggcacacaggaaaaggcccacaaagagaagcccaaccagccagcccccaggccgccccgccagggacccaccaatgaggcacagatggcagccgctgccgccctagcccggctggagcagaagcagtcccgggcctggggccccacatcgcaggacaccatccgaaaccaggtgagaaaggaacttcaagccgaagccaccgtcagcgggagccccgaggccccagggaccaacgtggtatctgagcccagagaggaaggctctgcccacctggctgtgcctggcgtgtacttcacctgtccgctcactggggccaccctgaggaaggaccagcgggacgcctgcatcaaggaggccattctcttgcacttctccaccgacccagtggccgcctccatcatgaagatctacacgttcaacaaagaccaggaccgggtgaagctgggtgtggacaccattgccaagtacctggacaacatccacctgcaccccgaggaggagaagtaccggaagatcaagctgcagaacaaggtgtttcaggagcgcattaactgcctggaagggacccacgagttttttgaggccattgggttccagaaggtgttgcttcccgcccaggatcaggaggaccccgaggagttctacgtgctgagcgagaccaccttggcccagccccagagcctggagaggcacaaggaacagctgctggctgcggagcccgtgcgcgccaagctggacaggcagcgccgcgtcttccagccctcgcccctggcctcgcagttcgaactgcctggggacttcttcaacctcacagcagaggagatcaagcgggagcagaggctcaggtccgaggcggtggagcggctgagcgtgctgcggaccaaggccatgcgggagaaggaggagcagcgggggctgcgcaagtacaactacacgctgctgcgcgtgcgcctccccgatggctgcctcctgcagggcactttctacgctcgggagcggctgggggcggtgtacgggttcgtccgggaggccctgcagagcgactggctgccttttgagctgctggcctcgggagggcagaagctgtccgaggacgagaacctggccttgaacgagtgcgggctggtgccctctgccctcctgaccttctcgtgggacatggctgtgctggaggacatcaaggccgcgggggccgagccggactccatcctgaaacccgagctcctgtcagccatcgagaagctcttgtga

SEQ ID NO: 6343 - DNA, 514 bp, synthetic construct
  misc_feature 1..514: note = Synthetic polypeptide
  source 1..514: mol_type = other DNA
gcgtggcatggggcacatcgcccggacttcctgtccctcttgggtttaggaatgggatggtgaggcctccctggcagcttgttaggaggagtaaaccaagcgagccgaccagctcccagcagggtcctggcacacaggaaaaggcccacaaagagaagcccaaccagccagcccccaggccgccccgccagggacccaccaatgaggcacagatggcagccgctgccgccctagcccggctggagcagaagcagtcccgggcctggggccccacatcgcaggacaccatccgaaaccaggtgagaaaggaacttcaagccgaagccaccgtcagcgggagccccgaggccccagggaccaacgtggtatctgagcccagagaggaaggctctgcccacctggctgtgcctggcgtgtacttcacctgtccgctcactggggccaccctgaggaaggaccagcgggacgcctgcatcaaggaggccattctcttgcacttctccaccgacccagt

SEQ ID NO: 6344 - DNA, 576 bp, synthetic construct
  misc_feature 1..576: note = Synthetic polypeptide
  source 1..576: mol_type = other DNA
gatcagagacagtttttgctaatctttggagaaataagataaaaaagtaaaaatgtcagtatagtttttcttaaatccaattttattcaagctaaaggcacacacaccatttcttctgagattatgtttaagtgctgtggagtagtatatttcactgactggttggaaatgacagagatggactggcccccagattcctgctgtgttagagaattcccaggatgttccaaacaggcccaccaggaagatctcagtgacctttatcaagagggttgtgggaagaaaatgtattcctttttgagaggaaccaaacaactgcaggtgctgaggtttctgggaatctccattggggtgacacaaatcctggccatgattctcaccattactctgctctgggctctgtattatgatagaagggagccggggacagaccaaatgatgtccttgaagaatgacaactctcagcacctgtcatgtccctcagtagaactgttgaaaccaagcctgtcaagaatctttgaacacacatccatggcaaacagctttaatacacactttgagatggaggagttataa

SEQ ID NO: 6345 - DNA, 1883 bp, synthetic construct
  misc_feature 1..1883: note = Synthetic polypeptide
  source 1..1883: mol_type = other DNA
caccgtctccctctgatgccgagccgaggctggactgtactgccaccatcttgactcactgcaacctccctgcctgattctcctgcctcagtctgccgagttcctgggattgcaggtgcgcgccgccactcctgactggtttttgtattttttggtggagacggggtttcaccgtgttggccgggctggtctccagctcctgaccgcgagtgatctgccagcctcggcgtcctgaggtgccgggattgcagacggagtctcgctcactcagtgctcaatgttgcccatgctggagtgcagtggcgtgatcttggctcgctacaacctccacctcccagccgcctgccttggcctcccaaagtgccgagattgcagcctctgcccggccgccaccccgtctaggaagtgaggagcgtctttgcctggccgcccatcgtcggggatgtgaggagcccctctgcccggccgcccagtctgggaagtgaggagcacctcttcccggccgtcatcctgtctaggaagtgaggagcgtctctgcccagccgcccatcatctgggatgtggggagcatctctgccccgtcgccccgtctgagatgtgaagagcgcctctgcccggccgcgaccctgtctgggaactgaggagtgtctctgccccgccgccaccccgtctgggaggtgaggagcgtctctgaccggctgcccggtctgagaagtgaggagcccctccgcccggcagccgccccgtctgggaagtgaggagcgtttccgctttccgcccggcagcggccccgtccgggaggtggggggcagcccccgcccggccggcgccccgtctgggaggtggagggcgcctctgcccggccgccccatctgggaagtgaggagcccctctgcccggccgccaccccgtctgggaggattttctgccgtctcttggcaaaaatggcaaataatgatgctgttctgaagagactggagcagaagggtgcagaggcagatcaaatcattgaatatcttaagcagcaagtttctctacttaaggagaaagcaattttgcaggcaactttgagggaagagaagaaacttcgagttgaaaatgctaaactgaagaaagaaattgaagaactgaaacaagagctaattcaggcagaaattcaaaatggagtgaagcaaataccatttccatctggtactccactgcacgctaattctatggtttctgaaaatgtgatacagtctacagcagtaacaaccgtatcttctggtaccaaagaacagataaaaggaggaacaggagacgaaaagaaagcgaaagagaaaattgaaaagaaaggagagaagaaggagaaaaaacagcaatcaatagctggaagtgccgactctaagccaatagatgtttcccgtctggatcttcgaattggttgcatcataactgctagaaaacaccctgatgcagattctttgtatgtggaagaagtagatgtcggagaaatagccccaaggacagttgtcagtggcctggtgaatcatgttcctcttgaacagatgcaaaatcggatggtgattttactttgtaacctgaaacctgcaaagatgaggggagtattatctcaagcaatggtcatgtgtgctagttcaccagagaaaattgaaatcttggctcctccaaatgggtctgttcctggagacagaattacttttgatgctttcccaggagagcctgacaaggagctgaatcctaagaagaagatttgggagcagatccagcctgatcttcacactaatgatgagtgtgtggctacatacaaaggagttccctttgaggtgaaagggaagggagtatgtagggctcaaaccatgagcaacagtggaatcaaataa

SEQ ID NO: 6346 - DNA, 508 bp, synthetic construct
  misc_feature 1..508: note = Synthetic polypeptide
  source 1..508: mol_type = other DNA
ggcttggcacggtggcacacgcctgtaatcccagcactttgggaggccaaggttggcggatcacctgaggtatcaaggttacattggtgcagccctagttttagggggagtagatgttactggacctcacctctacagcatctatcctcatggatcaactgataagttgccttatgtcaccatgggttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgcccatacacagtgcccaacaagaaggggaccaggcttggccggtacaggtgtgagaaagggactactgcagtcctcactgagaaaatcactcctctggagattgaggtgctggaagaaacagtccaaacaatggacacttcctga

SEQ ID NO: 6347 - DNA, 305 bp, synthetic construct
  misc_feature 1..305: note = Synthetic polypeptide
  source 1..305: mol_type = other DNA
ggcttggcacggtggcacacgcctgtaatcccagcactttgggaggccaaggttggcggatcacctgaggtatcaaggttacattggtgcagccctagttttagggggagtagatgttactggacctcacctctacagcatctatcctcatggatcaactgataagttgccttatgtcaccatggtccattgtgaagaggagctctttacagagaatcttttctttattaggcaagctgaagtagtgtcagaagaagcttggggaccatcttttgctattagcttggcagtgttccttgtagcag

SEQ ID NO: 6348 - DNA, 709 bp, synthetic construct
  misc_feature 1..709: note = Synthetic polypeptide
  source 1..709: mol_type = other DNA
tttctttacagtttctccctgggtgatctcatccgttctgtgaccttaaatcctttctagatattgataaactcttaaatttacatccttagctcagacctctcctctgagccctgatttacagatctaacttcttgctttacatcacttcttggaaatctaacatatttaaaacagcttttgccttttttcctcctgatgaaacctgtccttcctcgagtctttcctacctcagtaatgagcaccacccggctgctcgaacctgaaaccgtagagcaccattccttcctctttcttcccaacctgacatccagtccatcggcacctcctgccagttgtgcccccaagattcgcctccagcatgtcctgttggctccatccctacagtcggcacgaggggctggccagccactgggcgcctggagctgtgctaacctgcttctgctctggagtttaacagccaggtgcatgtgagggaaccctggcttgttcaacctgtcacctcatctttgaagatcacatatatgagaagttagatgcaatcactgatgaggagaatgacatgctcgatctggcatatggactaacagacagatcacggttgggctgccaaatctgtttgacaaaatctatggacaatatgactgttcgagtgcctgaaacagtggctgatgccagacaatccattgatgtgggcaagacctcctga

SEQ ID NO: 6349 - DNA, 588 bp, synthetic construct
  misc_feature 1..588: note = Synthetic polypeptide
  source 1..588: mol_type = other DNA
tgaaatggtttggatatgtgtcacctccaaatatcatgttgaaatgtgacctccagtgttggaggtgagcctagtgggaagtgtttgggtcatgggggtggatccctcatgaatggtgtggtgctgtccttgtgataatgaaagagttcttgctctgacttcatgtgagatctggttgtttaaaagagcgtggcacctcctcttgctctcactgccactctcatcttgtgatgtgcctgctctcccttcacctcctgccatgattgtaagcttgctgaggtctttgccagaagcagatgctggcaccatgcttcctgtacagcctgcagaactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagaga

SEQ ID NO: 6350 - DNA, 1376 bp, synthetic construct
  misc_feature 1..1376: note = Synthetic polypeptide
  source 1..1376: mol_type = other DNA
tgaaatggtttggatatgtgtcacctccaaatatcatgttgaaatgtgacctccagtgttggaggtgagcctagtgggaagtgtttgggtcatgggggtggatccctcatgaatggtgtggtgctgtccttgtgataatgaaagagttcttgctctgacttcatgtgagatctggttgtttaaaagagcgtggcacctcctcttgctctcactgccactctcatcttgtgatgtgcctgctctcccttcacctcctgccatgattgtaagcttgctgaggtctttgccagaagcagatgctggcaccatgcttcctgtacagcctgcagaactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaagggatgccaagggagcagagatgcctgcagcccgtgggagcaagtcctggcctttgcagttgcaaaaactggctgcaagctgctccagccccagaggaactggccaagctccagagggcctccttggagggcctcagagggagagagaactgctcagtaa

SEQ ID NO: 6351 - DNA, 1280 bp, synthetic construct
  misc_feature 1..1280: note = Synthetic polypeptide
  source 1..1280: mol_type = other DNA
tgaaatggtttggatatgtgtcacctccaaatatcatgttgaaatgtgacctccagtgttggaggtgagcctagtgggaagtgtttgggtcatgggggtggatccctcatgaatggtgtggtgctgtccttgtgataatgaaagagttcttgctctgacttcatgtgagatctggttgtttaaaagagcgtggcacctcctcttgctctcactgccactctcatcttgtgatgtgcctgctctcccttcacctcctgccatgattgtaagcttgctgaggtctttgccagaagcagatgctggcaccatgcttcctgtacagcctgcagaactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctag

SEQ ID NO: 6352 - DNA, 1259 bp, synthetic construct
  misc_feature 1..1259: note = Synthetic polypeptide
  source 1..1259: mol_type = other DNA
tgaaatggtttggatatgtgtcacctccaaatatcatgttgaaatgtgacctccagtgttggaggtgagcctagtgggaagtgtttgggtcatgggggtggatccctcatgaatggtgtggtgctgtccttgtgataatgaaagagttcttgctctgacttcatgtgagatctggttgtttaaaagagcgtggcacctcctcttgctctcactgccactctcatcttgtgatgtgcctgctctcccttcacctcctgccatgattgtaagcttgctgaggtctttgccagaagcagatgctggcaccatgcttcctgtacagcctgcagaactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaaagagagagcaacagagatggggaggaatccagctctgcctga

SEQ ID NO: 6353 - DNA, 981 bp, synthetic construct
  misc_feature 1..981: note = Synthetic polypeptide
  source 1..981: mol_type = other DNA
tgaaatggtttggatatgtgtcacctccaaatatcatgttgaaatgtgacctccagtgttggaggtgagcctagtgggaagtgtttgggtcatgggggtggatccctcatgaatggtgtggtgctgtccttgtgataatgaaagagttcttgctctgacttcatgtgagatctggttgtttaaaagagcgtggcacctcctcttgctctcactgccactctcatcttgtgatgtgcctgctctcccttcacctcctgccatgattgtaagcttgctgaggtctttgccagaagcagatgctggcaccatgcttcctgtacagcctgcagaactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcagttaagcctgagcccttgccacacggatttccttctcacccgcttcctccccgcaccactctggggatcagaagtatcagtgccaagtggtccctttcatctcctcataattcttccccagccacttagtgggttagtcaggccctgccttctcttcagccagccctgcagtc

SEQ ID NO: 6354 - DNA, 691 bp, synthetic construct
  misc_feature 1..691: note = Synthetic polypeptide
  source 1..691: mol_type = other DNA
tgaaatggtttggatatgtgtcacctccaaatatcatgttgaaatgtgacctccagtgttggaggtgagcctagtgggaagtgtttgggtcatgggggtggatccctcatgaatggtgtggtgctgtccttgtgataatgaaagagttcttgctctgacttcatgtgagatctggttgtttaaaagagcgtggcacctcctcttgctctcactgccactctcatcttgtgatgtgcctgctctcccttcacctcctgccatgattgtaagcttgctgaggtctttgccagaagcagatgctggcaccatgcttcctgtacagcctgcagaactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactgggtaaggatttttgagaatggaaaaaaagatgacttcatccataataaaataatcaattcatatgtcca

SEQ ID NO: 6355 - DNA, 1002 bp, synthetic construct
  misc_feature 1..1002: note = Synthetic polypeptide
  source 1..1002: mol_type = other DNA
aatagccaaaagatggaagcaacccagatatccactgacaggtgagtgaataaacaaaatgtggtatatagctataatggaatgttattcatccttgagaaggaagaaaattctgatgcatgatacaacagagataaacatcaaggacattatgctaaatgaaataagccagtcacaaaaatacaaatagtgtgtgattccacttacataaggtacctggagtcatcaagtccatagaaacagaaagtacactggcggctgccaggggctgaagagaagggaacaaactggttggctgagattctctgcctgatgcactccaagggggatgccaagtggatccaatctgtgcccatctgggagcgatcaccctgggtagagagtgagattgggtatacagcactcagtgaaacggagagtccacgtttattctcctcccacctccccatccagttattccccaagtctttcttcagttccaaggccaaggtgatttatctcatgagaaatcccagagatgttttggtgtctggttattttttctggaaaaacatgaagtttattaagaaaccaaagtcatgggaagaatattttgaatggttttgtcaaggaactgtgctatatgggtcatggtttgaccacattcatggctggatgcccatgagagaggagaaaaacttcctgttactgagttatgaggagctgaaacaggacacaggaagaaccatagagaagatctgtcaattcctgggaaagacgttagaacccgaagaactgaacttaattctcaagaacagctcctttcagagcatgaaagaaaacaagatgtccaattattccctcctgagtgttgattatgtagtggacaaagcacaacttctgagaaaaggtgtatctggggactggaaaaatcacttcacagtggcccaagctgaagactttgataaattgttccaagagaagatggcagatcttcctcgagagctgttcccatgggaataa

SEQ ID NO: 6356 - DNA, 325 bp, synthetic construct
  misc_feature 1..325: note = Synthetic polypeptide
  source 1..325: mol_type = other DNA
aaaataaaattataaaccctcaaccatctgaacggacccctcctgtcgggcaaaggcattgcaaagttatcctaaaaaactagttcaggtcacgaagggaaggagaagtttggacatgcctcattattccctcctcccttttggaattcagacactgctgaccagcattaccattaaaacagatcttaagactgatagaacagactctttaaatctggatataatcacagatccatttaagcttgcagaagagtctgacagtatgaagtccagatgtgtccctgatgctgctggaggctgctgtggcacaaagaaaagctgctaa

SEQ ID NO: 6357 - DNA, 742 bp, synthetic construct
  misc_feature 1..742: note = Synthetic polypeptide
  source 1..742: mol_type = other DNA
ggatttggggaccaggcaggtctctgagtctcaggccccttcccaccttgtgatggtttttgagcctttgccccagtgtctggctgttcgttgggtacacagtaatctcatctgacaagtttgtgaatttgggaagaaataattcacaggagatgctcatcacggggttttgcacacaggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcacagccacaccaaaccctacgtccgctccaagggccggaagttcgagcgtgccagaggccgacgggccagccgaggctacaaaaactaa

SEQ ID NO: 6358 - DNA, 590 bp, synthetic construct
  misc_feature 1..590: note = Synthetic polypeptide
  source 1..590: mol_type = other DNA
ggatttggggaccaggcaggtctctgagtctcaggccccttcccaccttgtgatggtttttgagcctttgccccagtgtctggctgttcgttgggtacacagtaatctcatctgacaagtttgtgaatttgggaagaaataattcacaggagatgctcatcacggggttttgcacacaggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaagaccctacgtccgctccaagggccggaagttcgagcgtgccagaggccgacgggccagccgaggctacaaaaactaaccctggatcctactctcttattaaaaagatttttgctgacag

SEQ ID NO: 6359 - DNA, 577 bp, synthetic construct
  misc_feature 1..577: note = Synthetic polypeptide
  source 1..577: mol_type = other DNA
ggatttggggaccaggcaggtctctgagtctcaggccccttcccaccttgtgatggtttttgagcctttgccccagtgtctggctgttcgttgggtacacagtaatctcatctgacaagtttgtgaatttgggaagaaataattcacaggagatgctcatcacggggttttgcacacaggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggccccaggaaccccgcacagccacaccaaaccctacgtccgctccaagggccggaagttcgagcgtgccagaggccgacgggccagccgaggctacaaaaactaa

SEQ ID NO: 6360 - DNA, 430 bp, synthetic construct
  misc_feature 1..430: note = Synthetic polypeptide
  source 1..430: mol_type = other DNA
ggatttggggaccaggcaggtctctgagtctcaggccccttcccaccttgtgatggtttttgagcctttgccccagtgtctggctgttcgttgggtacacagtaatctcatctgacaagtttgtgaatttgggaagaaataattcacaggagatgctcatcacggggttttgcacacaggagtggacatccgccataacaaggaccgaaaggttcggcgcaaggagcccaagagccaggatatctacctgaggctgttggtcaaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactga

SEQ ID NO: 6361 - DNA, 670 bp, synthetic construct
  misc_feature 1..670: note = Synthetic polypeptide
  source 1..670: mol_type = other DNA
ggatttggggaccaggcaggtctctgagtctcaggccccttcccaccttgtgatggtttttgagcctttgccccagtgtctggctgttcgttgggtacacagtaatctcatctgacaagtttgtgaatttgggaagaaataattcacaggagatgctcatcacggggttttgcacacaggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcacagccacaccaagtga

SEQ ID NO: 6362 - DNA, 892 bp, synthetic construct
  misc_feature 1..892: note = Synthetic polypeptide
  source 1..892: mol_type = other DNA
ttagagccctagacttctttgtttgaaagatacctgctggactagcagtctttcttcctgtctctctctgtctggagggaggattgatccctgacttcctgggttggtagtttttcttcctggctctcagtcttgagtgggaaatttttcttggctctttgtgaggcctctccattctctctattttatcctgtttctctcatggaaaattctcagttggctgaaactcccttcttgaactcctactgactatatgctctaccaatctgtccacctccttcctgttggcataaatttgcagagaataatttggaacttcattgtcctctttgggaaacttatgatctccccaaactggcttctgtaaggcctctcccttcccattcctcctttgttctttaaccacttttgatcttcccttcagcgaccttgaagcctttgatatatcccccttttaactctaccaccttcatccctctgttcattctgccaggcttttcatttcccacttcaacctctcagctcccaacagtcacttgaactatagaccccttggcctccattgggggctctccttaagagactgagggatccctgagggatccccaaaagcaatgattagaggctgaaaacagaaaaaaaactttggaaacagactggatgttttgtacactcagagaatccgacaacagctgctccagctgacacgtatccagctactggtcctgctgatgatgaagcccctgatgctgaaaccactgctgctgcaaccactgcaaccactgctgctcctaccactgcaaccaccgctgcttctaccactgctcgtaaagacattccagttttacccaaatgggttggggatctcccgaatggtagagtgtgtccctga

SEQ ID NO: 6363 - DNA, 348 bp, synthetic construct
  misc_feature 1..348: note = Synthetic polypeptide
  source 1..348: mol_type = other DNA
cctggatttgaagaccagccctgctacttaccagccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaagcttga

SEQ ID NO: 6364 - DNA, 80 bp, synthetic construct
  misc_feature 1..80: note = Synthetic polypeptide
  source 1..80: mol_type = other DNA
gctgggtgtggtggcgcgtgcctgtaatcctaccgctttgggaggctgaggccaagaagacgctggagggaggctgttag

SEQ ID NO: 6365 - DNA, 217 bp, synthetic construct
  misc_feature 1..217: note = Synthetic polypeptide
  source 1..217: mol_type = other DNA
gctgggtgtggtggcgcgtgcctgtaatcctaccgctttgggaggctgaggccaagaagacgctggagggaggctgttaggagggactctgagcttcacacctgtctgctgccatgggtgcagagccctagtcctgatggcccctggtggcacatatcgaatgcctagggcagaaaggaagtgggaatggcgaagatgtgacattcctcggtgttag

SEQ ID NO: 6366 - DNA, 2319 bp, synthetic construct
  misc_feature 1..2319: note = Synthetic polypeptide
  source 1..2319: mol_type = other DNA
cctcatttgactgtactttacatatatttcattttttacaaattgaaggtttatggcaatcttgctttgagcaagcttattggcaccattttttccaacagcatgtgctcactttgtgtttctgtgtcacgctttggtaattctcccaacatttcaaacgttttattattatatctgttatggtatctgtgatcagtgatctttgatattactaccgtaattgttttgggatgccacaaactatacccatatatgctggcaaacttaattgatttcatgtatgtgttctgactgctccattaaccagccatttccccatctcttttcctctctttgaacttctctattccctgagacacaataatattgaaatgaggccagataataaccctacaaaggcctgtaagcattcaagtcacacgtctctcactttaagtcaaaaactagaaatgattaagcttagtgaggaaggcatattgaaagccaggatggtctgatagctaggcctcttgtgcaaaacaataagccaagttgtgaatgcaaaggaaaagttcttgaaggaaattaaaagtgctgctccagtgaacacatgaatgacgagaaagcaaaacagtattattgctgatatggagaaagtttgagtggtctggatagaagatcaaactagctacaacattttcttaagcctaatctggagcaaggccatacctcttttcagttctgttaaggctgagagaggtgaggaagctacagaagaaaggtctgaagctagcagttggttcatgaggtttaaggaaagaagtcatctccataacataaaagtgcatggtgaagcagcatatgctgatggagaagctgcaagttatccagaagatcaagctcagatcttccgtgaaggtggctacgtaaacaacagattttccatgtagatgactagccttctcttgggaagaagatgccatctaggacttctgtagctagagaggagatgtcaacacctgccttcaaagcttcaaaggacaggctgattgtcttgttaatgcagacggtgactttcagttgaagccaatgatcatttgatattcagaaaattttagggtccttaagaatgatgctaaatcttctctgcctatgttctataaatggaacaacagagccgggatgatagtatatctatttatagcctggattactgaatctcttaagccctctgttgagacgtactgctcagaaaaagattcctttgaaaatattactgctaattgacaatgcaccttgtaatccaagaagtccgatatagatatatttacaaagagattaatattttcatttctgctaacacagcatccattctgcagcccatggatcaaggaatcatttagactttcatttcttgttatttaagaaatacagtttgtgagactatagctgccacagtgattgctttgatggatctgagaatagtaaattggaaacttcctggaaaggattcaccattttagatgcccttaagaacattcatgatttatgggaagagctcaaagtatcaacattaacatgagtttggaataagttggttccaatcctcatggatgactttgaggggtttaagacttcattggaggaagtaactgcagatatcatgaaaatagcaagaaaactagaattagaaggggagcctgaagatgtgactgaactgctgcaatctcatgataaaacttgaacaagtaaggagttgcttcttaaagatgagcaaataaactgatttcttgagatggaatctactcctaataaagaggtcatgaacagtgttaaaatgaccacaaaccataaaggatttagaagattacataaatgtagttgataaagcagcagcagaatttgagaggattgacaacatttttggaagaagttctcctgtgggtaaagtgctgtcaaacagcatcacatgctacagagaaatctttcataaaagaaagagtcaaatgtggcaaacttcattattgtcttattttaggaaatttccacagccaccccaatcttcagcaaccgccgtcctgatcagtcaggagatatcaacatcaaagcaagcccctccatcagcaaaaagatggcaacttgctgaaggctgagatgatcattagcatttttaggaataaagtgttttttaattaagatgggcggaagccatttccaattaaccatggtgaaactagtgatgaaactttattagaggatgccatagaagtttgcaagaagtttatggagcgcgaccctgatgaactaagatttaatgcgattgctctttctgcagcatag

SEQ ID NO: 6367 - DNA, 348 bp, synthetic construct
  misc_feature 1..348: note = Synthetic polypeptide
  source 1..348: mol_type = other DNA
tgtggttcccaaaccaggctgtacatcagagtaacctaggaaacgtcaacaaacacagtgaatggcctccaagctcggacctttgggatctggacgctgctctcatcagtgattcgctgcctctgtgccattgacattcacaacaagacgctctatcacatcacactctggaccttcctccttgccctggggcatttcctctctgagttgtttgtctatggaactgcagctcccacgattggcgtcctggcacccctgatggtggcaagtttctccatcctgggtatgctggtcgggctccggtatctagaagtagaaccagtatccagacagaagaagagaaactga

SEQ ID NO: 6368 - DNA, 1050 bp, synthetic construct
  misc_feature 1..1050: note = Synthetic polypeptide
  source 1..1050: mol_type = other DNA
ggccgggcgcggtggctcacacctgtaatcctagcactttgggaggctgaggcgggcggatcacgagatcaggagatcgagaccatcctggctaacatgcctcagaagtcccgggctgaagacctgggcctgaaggcgaaggccctggagaagacagttgcatcatggcagcacatggccactgaggctgcccgaaccctccagactgctgcccaggcgacgctacggcaaacagaacccctcacaaagctgcaccaggaggccagagccgccctgacccaggcttcctcatctgtccaggctgcgacagtgactgtcatgggagccaggactctgctggctgatctggaaggaatgaagctgcagtttccccggcccaaggaccaggcggcattgcagaggaaggcagactccgtcagtgacagactccttgcagacacgagaaagaagaccaagcaggcggagaggatgctgggaaacgcggcccctctttcctccagtgccaagaagaagggcagagaagcagaggtgttggccaaggacagtgccaagcttgccaaggccttgctgagggagcggaaacaggcgcaccgccgtgccagcaggctcaccagccagacgcaagccacgctccaacaggcgtcccagcaggtgctggcgtctgaagcacgcagacaggagctggaggaagctgagcgggtgggtgctgggctgagcgagatggagcagcagatccgggaatcgcgtatctcactggagaaggacatcgagaccttgtcagagctgcttgccaggctggggtcgctggacacccatcaagccccagcccaggccctgaacgagactcagtgggcactagaacgcctgaggctgcagctgggctccccggggtccttgcagaggaaactcagtctgctggagcaggaatcccagcagcaggagctgcagatccagggcttcgagagtgacctcgccgagatccgcgccgacaaacagaacctggaggccattctgcacagcctgcccgagaactgtgccagctggcagtga

SEQ ID NO: 6369 - DNA, 450 bp, synthetic construct
  misc_feature 1..450: note = Synthetic polypeptide
  source 1..450: mol_type = other DNA
gttgaaagcccctgcgttgaagtaatctgccgggacttgaaacttggctttggcactgattgtctgacgtgcctaacttgctcagaagataaaataacagtccactttataaaccgtgatggtgaaacattaacaaccaaaggaaaagttggtgattctctgctagatgttgtggttgaaaataatctagatattgatggctttggtgcatgtgagggaaccctggcttgttcaacctgtcacctcatctttgaagatcacatatatgagaagttagatgcaatcactgatgaggagaatgacatgctcgatctggcatatggactaacagacagatcacggttgggctgccaaatctgtttgacaaaatctatggacaatatgactgttcgagtgcctgaaacagtggctgatgccagacaatccattgatgtgggcaagacctcctga

SEQ ID NO: 6370 - DNA, 338 bp, synthetic construct
  misc_feature 1..338: note = Synthetic polypeptide
  source 1..338: mol_type = other DNA
ggccgggcgcggtggctcatgcctgtgatcccagccctttgggaggccgaggtgaatgtaaaagctttaaagagaaattcatgaagtgtcttcataacaataattttgaaaatgctttgtgcagaaaggaatcaaaagaatatttagaatgcaggatggagagatcccgactgggcctcctacactctgggcgtcttcatctgcctgagctgctcgggaatccaccggaatatcccccaggtcagcaaggtgaagtccgtccgcctggacgcctgggaggaggcccaagtggagttcatggcctcccacgggaacgacgccgcgagagccaggtttga

SEQ ID NO: 6371 - DNA, 242 bp, synthetic construct
  misc_feature 1..242: note = Synthetic polypeptide
  source 1..242: mol_type = other DNA
ggccgggcgcggtggctcatgcctgtgatcccagccctttgggaggccgaggtgaatgtaaaagctttaaagagaaattcatgaagtgtcttcataacaataattttgaaaatgctttgtgcagaaaggaatcaaaagaatatttagaatgcaggatggagagaaaattgatgctacaagaaccattggagaaactgggatttggagacttgactagtggaaaatcagaggcaaaaaaatga

SEQ ID NO: 6372 - DNA, 506 bp, synthetic construct
  misc_feature 1..506: note = Synthetic polypeptide
  source 1..506: mol_type = other DNA
tagatggaataatgcctccccaaaatatccaagtcctaatcactggaacctgtgaatatgttgacttgcatggcacaggggactttgcagatgtaatttagttaaggatcctaagattgaaaaattatactggactattcaggtggaacaatataatcacaaggattcttatcagagggaggcaggagggcccaagtcagagaagatgtgacaatggaagcagaagttagaatggtgcagtaaaagggccatgggccgaggaactcagacagcctgtagaagctggaaaaggaattttcaataaacgtgacttcactaggtggcctaagccccgatgtaaaatgtatatcccactggaccctgattacaatgcagactgccccaatgtgacagcacctgtttgtgcctcaaatggccacactttccagaatgagtgtttcttttgtgttgaacagagggaatttcattatcgtataaaatttgaaaaatatggaaaatgtgattaa

SEQ ID NO: 6373 - DNA, 605 bp, synthetic construct
  misc_feature 1..605: note = Synthetic polypeptide
  source 1..605: mol_type = other DNA
gccagcatggtggggagttatatttcagtgacgtctatacgagccttgaactgccagaagaaatcaggacacacaaagttttatggggtgagtgtctgggtggtgctttatactggaaggaacttgctgtccttgctcaaaaaattgggttctgccctccacgtttggtcactgccaatctcattacaattcaaaacaaggaactggaaagagttatcggtgactgtcgttttgtttctgcaacatttcgcctcttcaaacactctaagacaggaccaaccaagagatgccaagttatttacaatggaggaattacaggacatgaaaaagaactaatgtttgatgccaattttacatttaaggaaggtgaaattgttgaagtggatgaagaaacagcagctatcttgaagaattcaagatttgctcaagattttctgatcagaccaattggagagaagttgccaacatctggaggctgttctgctttggagttaaaggatataatcacagatccatttaagcttgcagaagagtctgacagtatgaagtccagatgtgtccctgatgctgctggaggctgctgtggcacaaagaaaagctgctaa

SEQ ID NO: 6374 - DNA, 665 bp, synthetic construct
  misc_feature 1..665: note = Synthetic polypeptide
  source 1..665: mol_type = other DNA
taattattcagttaccttctgtcttccttggtagatgtactcgggagaggagacgttttctgtcttgtgaactgtcgtttgccaagcacccggcctggcacagcgttcaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtaccgcaagatgaaggagcggctggggctgacggagatccggaagcaggccaaccgtatgagcttcggagagatcgaggaggacgcctaccaggaggacctgggattcagcctgggccacctgggcaagtcgggcagtgggcgtgtgcggcagacacaggtaaacgaggccaccaaggccaggatctccaagacgctgcagcggaccctgcagaagcagagcgtcgtatatggcgggaagtccaccatccgcgaccgctcctcgggcacggcctccagcgtggccttcaccccactccagggcctggagattgtgaacccacaggcggcagagaagaaggtggctgaggccaaccagaagtatttctccagcatggctgagttcctcaaggtcaagggcgagaagagtggccttatgtccacctga

SEQ ID NO: 6375 - DNA, 518 bp, synthetic construct
  misc_feature 1..518: note = Synthetic polypeptide
  source 1..518: mol_type = other DNA
taattattcagttaccttctgtcttccttggtagatgtactcgggagaggagacgttttctgtcttgtgaactgtcgtttgccaagcacccggcctggcacagcgttcaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtaccgcaagatgaaggagcggctggggctgacggagatccggaagcaggccaaccgtatgagcttcggagagatcgaggaggacgcctaccaggaggacctgggattcagcctgggccacctggacgctgcagcggaccctgcagaagcagagcgtcgtatatggcgggaagtccaccatccgcgaccgctcctcgggcacggcctccagcgtggccttcaccccactccagggcctggagattgtgaacccacaggcggcagagaagaaggtggctga

SEQ ID NO: 6376 - DNA, 243 bp, synthetic construct
  misc_feature 1..243: note = Synthetic polypeptide
  source 1..243: mol_type = other DNA
ggctgggcgcggtggctcacgcctgtaatcccagcactttgggaggccgaggtgggtggatcacgaggtcaggagatcgagaccatcctggctaacacagtgaaaccccatctctattgaaaaagtacaaaaaaaattagccgggcgtggtggcgggtgcctgtagtcccagctacgtgggaggctgaagcaggagaatggcatgaacccaggaggcggagcttgcgggtgtggccactgtaa

SEQ ID NO: 6377 - DNA, 877 bp, synthetic construct
  misc_feature 1..877: note = Synthetic polypeptide
  source 1..877: mol_type = other DNA
ggctgggcgcggtggctcacgcctgtaatcccagcactttgggaggccgaggtgggtggatcacgaggtcaggagatcgagaccatcctggctaacacagtgaaaccccatctctattgaaaaagtacaaaaaaaattagccgggcgtggtggcgggtgcctgtagtcccagctacgtgggaggctgaagcaggagaatggcatgaacccaggaggcggagcttgcgggtgtggccactgtaagaaaatgaagccggagtttgagaaggcagcagaagccctccatggagaagcggatagctctggtgtccttgcagctgtcgatgccactgtcaacaaggccctggcagaaagattccacatctcagagtttcctacgttgaagtattttaagaatggagagaaatacgcagtgcctgtgctcaggacaaagaagaagtttctcgagtggatgcaaaaccctgaggcccccccgcccccagagcccacgtgggaagagcagcagacaagcgtgttgcacctggtgggggacaacttccgggagaccctgaagaagaagaaacacaccttggtcatgttctacgccccttggtgcccacactgtaagaaggtcattccgcactttactgctactgctgatgccttcaaagatgaccgaaagattgcctgtgccgctgttgactgtgtcaaagacaagaaccaagacctgtgccagcaggaggcggtcaagggctaccccactttccactactaccactatgggaagttcgcagaaaagtatgacagcgaccgcacagaattgggatttaccaattatattcgagccctccgggagggagaccatgaaagactagggaaaaagaaggaagagttataa

SEQ ID NO: 6378 - DNA, 238 bp, synthetic construct
  misc_feature 1..238: note = Synthetic polypeptide
  source 1..238: mol_type = other DNA
ggccaagcgcggtggctcatgcttctcatcctagcactttgggaggccgaggcgggtggatcacctgagatcaggagttcaagaccagcctggccaagttggtgaaaccccgtctctactaaaaatagaaaaataaggcaggttctgtttggattctgcaaagcagactcgtcagaaagttgctgtgaactggaccaacttcagcctcaagaaaaccactcctagcacagctcagtga

SEQ ID NO: 6379 - DNA, 497 bp, synthetic construct
  misc_feature 1..497: note = Synthetic polypeptide
  source 1..497: mol_type = other DNA
ggccaggtacaccaggggttggaaaaaccacactaggcaaagaacttgcgtcaaaatcaggactgaaatacattaatgtgggtgatttagctcgagaagagcaattgtatgatggctatgatgaagagtatgactgtcccattttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttgaaatggattgagcagtggatcaaagatcataactcttga

SEQ ID NO: 6380 - DNA, 2878 bp, synthetic construct
  misc_feature 1..2878: note = Synthetic polypeptide
  source 1..2878: mol_type = other DNA
tggacagaacagcttgggagctgggcaccccagggtttagagcccacaacgcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccgggaagcgagggcgtcgcagcagtgcgggatcgctagagagcaatgtggaatttcagcctttcgagccactgcagccgtcagtgctgtgctcctaa

SEQ ID NO: 6381 - DNA, 2797 bp, synthetic construct
  misc_feature 1..2797: note = Synthetic polypeptide
  source 1..2797: mol_type = other DNA
tggacagaacagcttgggagctgggcaccccagggtttagagcccacaacgcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccggggtccatcattag

SEQ ID NO: 6382 - DNA, 3508 bp, synthetic construct
  misc_feature 1..3508: note = Synthetic polypeptide
  source 1..3508: mol_type = other DNA
tggacagaacagcttgggagctgggcaccccagggtttagagcccacaacgcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccgggaagcgagggcgtcgcagcagtgcgggatcgctagagagcaatgtggaagggtccatcattagcagtcctcacatgcgccggagagctacatcaacacgagagtgtccatctcgcccacaccagactatgcccaactcatcttccctcctgggctccttattcgggagcaagagagggaagccccctccccaggcccacctgccctcagccccagccctggccacccccccacccaccggtggtcctgcctcacttgcagcactctgtggctggccaccacctggggcccccagaggggctgccgcaggccgccatgcacgggcatcacacccagtactgccacatgcagaaccctcccccgtaccaccatcaccaccaccaccacccaccccagcacatccagcacgcacaccagtaccaccacggcccccatgggggccacccagcctacggggcccatgcccacggccacccgccgctgccctcggcccacgtggggcacacagtgcaccaccatgggcagccccctgccccgccgccccccaccagcagcaaggccaaacccagcggcatcagcacaattgtgtagacagcctgggtaggggtcccaggctccctgaaacacctgcacaccacacagggcacgcccgggggtcgccagccgcacaccaaacccggggcacttctgttgccatctctcccctctgcccctcacggcccaac

SEQ ID NO: 6383 - DNA, 467 bp, synthetic construct
  misc_feature 1..467: note = Synthetic polypeptide
  source 1..467: mol_type = other DNA
gctggacacagtggcacacacctgtaaccccagatatttgggaggctgagtcaggaggattgcttgagcctaggagttcaggtgactgtcgttttgtttctgcaacatttcgcctcttcaaacactctaagacaggaccaaccaagagatgccaagttatttacaatggaggaattacaggacatgaaaaagaactaatgtttgatgccaattttacatttaaggaaggtgaaattgttgaagtggatgaagaaacagcagctatcttgaagaattcaagatttgctcaagattttctgatcagaccaattggagagaagttgccaacatctggaggctgttctgctttggagttaaaggatataatcacagatccatttaagcttgcagaagagtctgacagtatgaagtccagatgtgtccctgatgctgctggaggctgctgtggcacaaagaaaagctgctaa

SEQ ID NO: 6384 - DNA, 201 bp, synthetic construct
  misc_feature 1..201: note = Synthetic polypeptide
  source 1..201: mol_type = other DNA
acaaaacaagaagtaggcgaggctgtggagtgacagctgtctcctgtgatgcagatggaggcatgcattgggtcacaagttgacatcaacttgtggagttgaacctgcatgtgccttaggatccagcagccctactacttgggtgcataccttagaggtgacccacggacatgcacaagctcatctacatgcactggatga

SEQ ID NO: 6385 - DNA, 1469 bp, synthetic construct
  misc_feature 1..1469: note = Synthetic polypeptide
  source 1..1469: mol_type = other DNA
acaaaacaagaagtaggcgaggctgtggagtgacagctgtctcctgtgatgcagatggaggcatgcattgggtcacaagttgacatcaacttgtggagttgaacctgcatgtgccttaggatccagcagccctactacttgggtgcataccttagaggtgacccacggacatgcacaagctcatctacatgcactggatgaacacggtggtgaattactgcggccccttcgagtatgaagtcggctactgcgagaggctgaagagcttcctggaggccaacctagagtggatgcaggaagagatggagtcaaacccagactcaccttactggcaccaggtgcggctgaccctcctgcagctgaaaggcctggaggacagctacgaaggccgtgtgagcttcccagctgggaagttcaccatcaaacccttggggttcctcctgctgcagctctctggggacctggaagacctggagctggccctgaacaagaccaagatcaaaccttctctgggctctggctcctgttctgccctcatcaagctgctccctggccagagtgacctcctggttgcccacaacacctggaacaactaccagcacatgctgcgtgtcatcaagaagtactggctccagttccgggaaggcccctggggggactacccgctggttcccggcaacaagctggtcttctcctcctaccccggcaccatcttctcctgcgacgacttctacatcctgggcagtgggctggtgacactggagaccaccattggcaacaagaacccagccctgtggaagtatgtgcggcccaggggctgtgtgctggagtgggtacgcaacatcgtggccaaccgcctggcctcggatggggccacctgggcagacatcttcaagaggttcaacagcggcaccggcatggtggtggtggctgacaagacctcggagctctaccagaagacctactgggccagctacaacataccgtccttcgagactgtgttcaatgccagtgggctgcaggccctagtggcccagtatggggactggttttcttatgacgggagcccccgggcccagatcttccggcggaaccagtcactggtacaagacatggactccatggtcaggctgatgaggtacaatgacttcctccatgaccctctgtcactgtgcaaagcctgcaacccccagcccaatggggagaatgctatctccgcccgctccgacctcaacccggccaatggctcctaccccttccaggccctgcgtcagcgctcccatgggggtatcgatgtgaaggtgaccagcatgtcactggccaggatcctgagcctgctggcggccagcggtcccacgtgggaccaggtgcccccgttccagtggagcacctcgcccttcagcggcctgctgcacatgggccagccagacctctggaagttcgcgcctgtcaaggtttcatgggactga

SEQ ID NO: 6386 - DNA, 1565 bp, synthetic construct
  misc_feature 1..1565: note = Synthetic polypeptide
  source 1..1565: mol_type = other DNA
acaaaacaagaagtaggcgaggctgtggagtgacagctgtctcctgtgatgcagatggaggcatgcattgggtcacaagttgacatcaacttgtggagttgaacctgcatgtgccttaggatccagcagccctactacttgggtgcataccttagaggtgacccacggacatgcacaagctcatctacatgcactggatgaacacggtggtgaattactgcggccccttcgagtatgaagtcggctactgcgagaggctgaagagcttcctggaggccaacctagagtggatgcaggaagagatggagtcaaacccagactcaccttactggcaccaggtgcggctgaccctcctgcagctgaaaggcctggaggacagctacgaaggccgtgtgagcttcccagctgggaagttcaccatcaaacccttggggttcctcctgctgcagctctctggggacctggaagacctggagctggccctgaacaagaccaagatcaaaccttctctgggctctggctcctgttctgccctcatcaagctgctccctggccagagtgacctcctggttgcccacaacacctggaacaactaccagcacatgctgcgtgtcatcaagaagtactggctccagttccgggaaggcccctggggggactacccgctggttcccggcaacaagctggtcttctcctcctaccccggcaccatcttctcctgcgacgacttctacatcctgggcagtgggctggtgacactggagaccaccattggcaacaagaacccagccctgtggaagtatgtgcggcccaggggctgtgtgctggagtgggtacgcaacatcgtggccaaccgcctggcctcggatggggccacctgggcagacatcttcaagaggttcaacagcggcacgtataacaaccagtggatgatcgtggactacaaggcgttcatcccgggtgggcccagccccgggagccgggtgcttaccatcctggagcagatccccggcatggtggtggtggctgacaagacctcggagctctaccagaagacctactgggccagctacaacataccgtccttcgagactgtgttcaatgccagtgggctgcaggccctagtggcccagtatggggactggttttcttatgacgggagcccccgggcccagatcttccggcggaaccagtcactggtacaagacatggactccatggtcaggctgatgaggtacaatgacttcctccatgaccctctgtcactgtgcaaagcctgcaacccccagcccaatggggagaatgctatctccgcccgctccgacctcaacccggccaatggctcctaccccttccaggccctgcgtcagcgctcccatgggggtatcgatgtgaaggtgaccagcatgtcactggccaggatcctgagcctgctggcggccagcggtcccacgtgggaccaggtgcccccgttccagtggagcacctcgcccttcagcggcctgctgcacatgggccagccagacctctggaagttcgcgcctgtcaaggtttcatgggactga

SEQ ID NO: 6387 - DNA, 555 bp, synthetic construct
  misc_feature 1..555: note = Synthetic polypeptide
  source 1..555: mol_type = other DNA
gttgaaagcccctgcgttgaagtaatctgccgggacttgaaacttggctttggcactgattgtctgacgtgcctaacttggtcagtccttaggaacccagtttctccatttgcaagttggatataataacagtgtagacctcctatggttaattgaagaatcaatgagttaatacagcgatacagctcagaagataaaataacagtccactttataaaccgtgatggtgaaacattaacaaccaaaggaaaagttggtgattctctgctagatgttgtggttgaaaataatctagatattgatggctttggtgcatgtgagggaaccctggcttgttcaacctgtcacctcatctttgaagatcacatatatgagaagttagatgcaatcactgatgaggagaatgacatgctcgatctggcatatggactaacagacagatcacggttgggctgccaaatctgtttgacaaaatctatggacaatatgactgttcgagtgcctgaaacagtggctgatgccagacaatccattgatgtgggcaagacctcctga

SEQ ID NO: 6388 - DNA, 148 bp, synthetic construct
  misc_feature 1..148: note = Synthetic polypeptide
  source 1..148: mol_type = other DNA
ggcagactgggggaagggagagacatggaaggcctgggagtctacgttttcatcctggcttcactgtgtgactggaacaacaaggtgtccctgccttcactgtgctccaacctgaaggtcccctggcagtgctgagggaccgagccca

SEQ ID NO: 6389 - DNA, 1100 bp, synthetic construct
  misc_feature 1..1100: note = Synthetic polypeptide
  source 1..1100: mol_type = other DNA
ggcagactgggggaagggagagacatggaaggcctgggagtctacgttttcatcctggcttcactgtgtgactggaacaacaaggtgtccctgccttcactgtgctccaacctgaaggtcccctggcagtgctgagggaccgagcccagcagatctcatgtcctctatacctgtgtccgatgctggaggccctcgaggaaggggggccgccgctgaccctgggcctggagggggagcaccagcggtccaacgccgccttggccttgcagctggcccactgctggctgcagcggcaggaccgccatggtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtag

SEQ ID NO: 6390 - DNA, 464 bp, synthetic construct
  misc_feature 1..464: note = Synthetic polypeptide
  source 1..464: mol_type = other DNA
ggcagactgggggaagggagagacatggaaggcctgggagtctacgttttcatcctggcttcactgtgtgactggaacaacaaggtgtccctgccttcactgtgctccaacctgaaggtcccctggcagtgctgagggaccgagcccagcagatctcagtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctga

SEQ ID NO: 6391 - DNA, 280 bp, synthetic construct
  misc_feature 1..280: note = Synthetic polypeptide
  source 1..280: mol_type = other DNA
ggcagactgggggaagggagagacatggaaggcctgggagtctacgttttcatcctggcttcactgtgtgactggaacaacaaggtgtccctgccttcactgtgctccaacctgaaggtcccctggcagtgctgagggaccgagcccagcagatctcagtgctggggagccaaaggcatccaggccagggctcctgtggcagctgcccctggcacctgtgttccagcccacatcccacatgcggctcgggcttcggaacacggagtggccgggccggacg

SEQ ID NO: 6392 - DNA, 1290 bp, synthetic construct
  misc_feature 1..1290: note = Synthetic polypeptide
  source 1..1290: mol_type = other DNA
ggccaggtgcagtggctcacgcctgtaatcccagcactttgggaggctgaagctggcggatcacctgaggcaactttttcctgtacctgtgaggagcagtacgtgggtactttctgtgaagaatacgatgcttgccagaggaaaccttgccaaaacaacgcgagctgtattgatgcaaatgaaaagcaagatgggagcaatttcacctgtgtttgccttcctggttatactggagagctttgccagtccaagattgattactgcatcctagacccatgcagaaatggagcaacatgcatttccagtctcagtggattcacctgccagtgtccagaaggatacttcggatctgcttgtgaagaaaaggtggacccctgcgcctcgtctccgtgccagaacaacggcacctgctatgtggacggggtacactttacctgcaactgcagcccgggcttcacagggccgacctgtgcccagcttattgacttctgtgccctcagcccctgtgctcatggcacgtgccgcagcgtgggcaccagctacaaatgcctctgtgatccaggttaccatggcctctactgtgaggaggaatataatgagtgcctctccgctccatgcctgaatgcagccacctgcagggacctcgttaatggctatgagtgtgtgtgcctggcagaatacaaaggaacacactgtgaattgtacaaggatccctgcgctaacgtcagctgtctgaacggagccacctgtgacagcgacggcctgaatggcacgtgcatctgtgcacccgggtttacaggtgaagagtgcgacattgacataaatgaatgtgacagtaacccctgccaccatggtgggagctgcctggaccagcccaatggttataactgccactgcccgcatggttgggtgggagcaaactgtgagatccacctccaatggaagtccgggcacatggcggagagcctcaccaacatgccacggcactccctctacatcatcattggagccctctgcgtggccttcatccttatgctgatcatcctgatcgtggggatttgccgcatcagccgcattgaataccagggttcttccaggccagcctatgaggagttctacaactgccgcagcatcgacagcgagttcagcaatgccattgcatccatccggcatgccaggtttggaaagaaatcccggcctgcaatgtatgatgtgagccccatcgcctatgaagattacagtcctgatgacaaacccttggtcacactgattaaaactaaagatttgtaa

SEQ ID NO: 6393 - DNA, 337 bp, synthetic construct
  misc_feature 1..337: note = Synthetic polypeptide
  source 1..337: mol_type = other DNA
ggagttagaaggcatcgcctctaatccaggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatag

SEQ ID NO: 6394 - DNA, 414 bp, synthetic construct
  misc_feature 1..414: note = Synthetic polypeptide
  source 1..414: mol_type = other DNA
ggcatggtggctcatgcctgtaatctcagcactctgagaggaggaggcggacggatcacttgaggccaggagttcgagaacagtctggccagcatggggtcccagctgccaaagcccagaatgctgagagaatcaggccatggggatgcccatctccaggagtacgctggcaatttccaaggcatacgtttccattatgatcgcaacccagggacagatgcagtggcgcagactagcctggaagagttcaatgtactggagatggaagtcatgagaagacagctgtatgcagtcaaccggcgtctgcgcgccctggaggaacagggcgccacctggcgccacagggagaccctgatcatcgccgtgctggtgtcggccagcattgccaacctgtggctgtggatgaaccagtga

SEQ ID NO: 6395 - DNA, 691 bp, synthetic construct
  misc_feature 1..691: note = Synthetic polypeptide
  source 1..691: mol_type = other DNA
gctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggacctgctccgaatcggagtcactctggcgggacaccagaagaaaatcttggccagtgtccagcacatgaagtcccaggccaagccgggaaccccgggtgggacaggaggaccggccccgcagtactga

SEQ ID NO: 6396 - DNA, 847 bp, synthetic construct
  misc_feature 1..847: note = Synthetic polypeptide
  source 1..847: mol_type = other DNA
gctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggcctcacaccctctcctggaccagcggcagcctcactactcagcttttggctctgtgggcgagtggcttcgggccatcaaaatgggaagatacgaagaaagtttcgcagccgctggctttggctccttcgagctggtcagccagatctctgctgaggacctgctccgaatcggagtcactctggcgggacaccagaagaaaatcttggccagtgtccagcacatgaagtcccaggccaagccgggaaccccgggtgggacaggaggaccggccccgcagtactga

SEQ ID NO: 6397 - DNA, 121 bp, synthetic construct
  misc_feature 1..121: note = Synthetic polypeptide
  source 1..121: mol_type = other DNA
attcaccatgtgaccctgagcatgtctttgaactcctctgagctcctgtttcctctccagagaaaaggctgttgtggctgtgcccatggtgctcagtgccatgggcttcactgcggcggga

SEQ ID NO: 6398 - DNA, 136 bp, synthetic construct
  misc_feature 1..136: note = Synthetic polypeptide
  source 1..136: mol_type = other DNA
attcaccatgtgaccctgagcatgtctttgaactcctctgagctcctgtttcctctccagagaaaaggctgttgtggctgtgcccatggtgctcagtgccatgggcttcactgcggcgggaatcgcctcgtcctcc

SEQ ID NO: 6399 - DNA, 310 bp, synthetic construct
  misc_feature 1..310: note = Synthetic polypeptide
  source 1..310: mol_type = other DNA
attcaccatgtgaccctgagcatgtctttgaactcctctgagctcctgtttcctctccagagaaaaggctgttgtggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactag

SEQ ID NO: 6400 - DNA, 230 bp, synthetic construct
  misc_feature 1..230: note = Synthetic polypeptide
  source 1..230: mol_type = other DNA
attcaccatgtgaccctgagcatgtctttgaactcctctgagctcctgtttcctctccagagaaaaggctgttgtggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaa

SEQ ID NO: 6401 - DNA, 235 bp, synthetic construct
  misc_feature 1..235: note = Synthetic polypeptide
  source 1..235: mol_type = other DNA
attcaccatgtgaccctgagcatgtctttgaactcctctgagctcctgtttcctctccagagaaaaggctgttgtggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactggggtttctctga

SEQ ID NO: 6402 - DNA, 848 bp, synthetic construct
  misc_feature 1..848: note = Synthetic polypeptide
  source 1..848: mol_type = other DNA
tagtgggtaagagtgtgggctctcgaggatgattgactgggtgtcctggcccctggggaagaatattgacaagtggatcattgcactgctgaagggcctggctgctgttaagaagttcagcatcttgatcgaggtttcgctcaccaaaattgagaaggttttctctaagctgctgtaccccatcgtccggggagctgccttgtctgtgctcaagtacatgctcctgaccttccagcactcccacgaagccttccacctgctcctccctcacatcccccccatggtggcctctctggtcaaggaggactcgaactcggggaccagctgcctggagcagctggcggagctggtccactgcatggtgttccggttcccgggcttcccggatctgtatgagcctgtcatggaggccatcaaggacctccatgttcccaatgaggaccgcatcaagcagctgctggggcaggatgcctggacttcgcagaagagcgagctggcgggtttctatccccggctcatggccaagtcagacacgggcaagattggtctcatcaacctgggcaacacatgctatgtcaacagcatccttcaggccttattcatggcgtctgacttcagacattgtgtgctccgcttgactgagaacaactcacagcccctgatgaccaagctgcagtggctctttggcttcctagaacacagccagcggcctgccatttccccagagaacttcctctccgcatcctggacgccctggttcagccctggcacccagcaggactgctcggagtatctgaagtacctgctggatcggctgcacgaagaggagaaaacgggcacaaggatct

SEQ ID NO: 6403 - DNA, 2278 bp, synthetic construct
  misc_feature 1..2278: note = Synthetic polypeptide
  source 1..2278: mol_type = other DNA
tagtgggtaagagtgtgggctctcgaggatgattgactgggtgtcctggcccctggggaagaatattgacaagtggatcattgcactgctgaagggcctggctgctgttaagaagttcagcatcttgatcgaggtttcgctcaccaaaattgagaaggttttctctaagctgctgtaccccatcgtccggggagctgccttgtctgtgctcaagtacatgctcctgaccttccagcactcccacgaagccttccacctgctcctccctcacatcccccccatggtggcctctctggtcaaggaggactcgaactcggggaccagctgcctggagcagctggcggagctggtccactgcatggtgttccggttcccgggcttcccggatctgtatgagcctgtcatggaggccatcaaggacctccatgttcccaatgaggaccgcatcaagcagctgctggggcaggatgcctggacttcgcagaagagcgagctggcgggtttctatccccggctcatggccaagtcagacacgggcaagattggtctcatcaacctgggcaacacatgctatgtcaacagcatccttcaggccttattcatggcgtctgacttcagacattgtgtgctccgcttgactgagaacaactcacagcccctgatgaccaagctgcagtggctctttggcttcctagaacacagccagcggcctgccatttccccagagaacttcctctccgcatcctggacgccctggttcagccctggcacccagcaggactgctcggagtatctgaagtacctgctggatcggctgcacgaagaggagaaaacgggcacaaggatctgccagaaactcaagcagtccagctcgccctctccgcccgaggagcccccggccccaagttcaacctctgtggaaaaaatgtttggaggcaagatagtgactcggatctgctgtctctgctgcctcaacgtctcctcccgggaggaggccttcacggacctctctctcgccttccctcctcctgagcgctgtcgccgccgccgcctgggctctgtgatgcgccccacagaagacatcacagcccgggagttgcccccaccaaccagtgcacaggggccaggcagggtgggtcctcggaggcaaaggaaacactgcatcacagaggacaccccccccaccagcctgtacatcgaaggcctggactccaaggaagctggtgggcagagcagtcaggaggaaaggatagagagggaggaagaagggaaggaggagagaacggagaaggaagaagtgggggaggaggaggaaagcaccagaggggaaggagagagggagaaagaggaggaggtggaagaggaagaagagaaggtggagaaggagacagaaaaggaggctgagcaggaaaaggaagaagacagcctgggagcggggacccacccggatgctgccatcccctccggggagcggacatgtggctctgagggctcccgctccgtcctggacctggttaactacttcctgtcccccgagaagctgacagcagaaaaccgctactactgcgagtcgtgtgcctccctgcaggatgccgagaaggtggtggagctgagccaagggccgtgctacctcatcctcacactgctgcgcttctctttcgacctgcgcaccatgcggcgccgcaagatcctggatgacgtctccatccccctgctgctccgcctgccactggctggtggccgtggccaggcctatgacctctgcagtgtggtggtgcactctggagtgtcttcggagagtggtcactactactgctatgcccgtgagggcgctgcccgccctgccgcttctctgggaactgccgataggccagagcccgagaaccagtggtacctgttcaatgacactcgggtgtccttctcttccttcgaatctgtcagcaacgtcacctccttcttccctaaggacacagcctatgtgctgttttaccggcagcggcccagggaggggcccgaggctgagttgggctcttctagagtccggacagagcccaccctgcacaaggacttgatggaagccatttccaaagacaacatcctttacctacaggagcaggagaaggaggcccggagcagggcggcctacatctctgcactccccacatctccgcactgggggaggggctttgatgaagacaaggatgaggatgaaggctctccagggggctgcaatcctgcaggtggcaatggtggtgacttccacagactggtcttctaa

SEQ ID NO: 6404 - DNA, 889 bp, synthetic construct
  misc_feature 1..889: note = Synthetic polypeptide
  source 1..889: mol_type = other DNA
agagatgaagcacacagtctcggaaatctggctgtgcaggttcaaattccagttctcctacttatctcttggtgataatagagtgacatccttcagagacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagagttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataa

SEQ ID NO: 6405 - DNA, 988 bp, synthetic construct
  misc_feature 1..988: note = Synthetic polypeptide
  source 1..988: mol_type = other DNA
agagatgaagcacacagtctcggaaatctggctgtgcaggttcaaattccagttctcctacttatctcttggtgataatagagtgacatccttcagagacctcattcatgaccaagatgaagatgaggaggaagaggaaggccagaggagcaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataa

SEQ ID NO: 6406 - DNA, 982 bp, synthetic construct
  misc_feature 1..982: note = Synthetic polypeptide
  source 1..982: mol_type = other DNA
agagatgaagcacacagtctcggaaatctggctgtgcaggttcaaattccagttctcctacttatctcttggtgataatagagtgacatccttcagagacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataa

SEQ ID NO: 6407 - DNA, 988 bp, synthetic construct
  misc_feature 1..988: note = Synthetic polypeptide
  source 1..988: mol_type = other DNA
agagatgaagcacacagtctcggaaatctggctgtgcaggttcaaattccagttctcctacttatctcttggtgataatagagtgacatccttcagagacctcattcatgaccaagatgaagatgaggaggaagaggaaggccagagagacaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataa

SEQ ID NO: 6408 - DNA, 694 bp, synthetic construct
  misc_feature 1..694: note = Synthetic polypeptide
  source 1..694: mol_type = other DNA
agagatgaagcacacagtctcggaaatctggctgtgcaggttcaaattccagttctcctacttatctcttggtgataatagagtgacatccttcagagacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcaggctgtcctgctttcctcccttcaagcccttgttcagttga

SEQ ID NO: 6409 - DNA, 187 bp, synthetic construct
  misc_feature 1..187: note = Synthetic polypeptide
  source 1..187: mol_type = other DNA
agagatgaagcacacagtctcggaaatctggctgtgcaggttcaaattccagttctcctacttatctcttggtgataatagagtgacatccttcagagacctcattcatgaccaagatgaagatgaggaggaagaggaaggccagaggggccacagtgtgtgtcacatgaatggcaaggtgaggtga

SEQ ID NO: 6410 - DNA, 75 bp, synthetic construct
  misc_feature 1..75: note = Synthetic polypeptide
  source 1..75: mol_type = other DNA
agagatgaagcacacagtctcggaaatctggctgtgcaggttcaaattccagttctcctacttatctcttggtga

SEQ ID NO: 6411 - DNA, 835 bp, synthetic construct
  misc_feature 1..835: note = Synthetic polypeptide
  source 1..835: mol_type = other DNA
agagattctctgcagaggttggaatcacccccttgggtgctggtagcaatctgtgaaggtagctttttagatgtcacaatgattgggggtggggtgctggtgacattggatgggcaggtgcagaactgctaaacaatgctctgggcaatcccacaaagcgaccacctggcccatatctggcatgactttcatgtcccgccggacattcaaggaatccgactatgttttctatataaacatatagtatttttcacatctgaaaatatacactgaattttccaggactgtgtataaatagaggtaagattgtactttattttgctcagaactttaccaagagttattaataatctccaaaaaatcaaattatagcaaacactaatgatgtttgagtcactaagcaacacacctatatctgtctgcattgtgatatcacattcgtggttattctacaggtacaagaatctgagcctcccttgtcctttagtgcaatcaagcagagtatccacatactgaaatacacaacattttctgtgacagattgactgggatcccctcgcacatcctcaacagctccccatcagaccggcagattaaccagctggcccagaggctgggccctgagtgggagcccatggtgctgtctctgggactgtcccagacggatatctaccgctgtaaggccaaccacccccacaacgtgcagtcgcaggtggtggaggccttcatccgttggcggcagcgcttcgggaagcaggccaccttccagagcctgcacaacgggctgcgggctgtggaggtggacccctcgctgctcctgcacatgttggagtga

SEQ ID NO: 6412 - DNA, 567 bp, synthetic construct
  misc_feature 1..567: note = Synthetic polypeptide
  source 1..567: mol_type = other DNA
ggccaggtgtggtggctaactcctgtaatcccagcactttgggaggccaaggcaggcagatcacttgagcttgccaaggccttgctgagggagcggaaacaggcgcaccgccgtgccagcaggctcaccagccagacgcaagccacgctccaacaggcgtcccagcaggtgctggcgtctgaagcacgcagacaggagctggaggaagctgagcgggtgggtgctgggctgagcgagatggagcagcagatccgggaatcgcgtatctcactggagaaggacatcgagaccttgtcagagctgcttgccaggctggggtcgctggacacccatcaagccccagcccaggccctgaacgagactcagtgggcactagaacgcctgaggctgcagctgggctccccggggtccttgcagaggaaactcagtctgctggagcaggaatcccagcagcaggagctgcagatccagggcttcgagagtgacctcgccgagatccgcgccgacaaacagaacctggaggccattctgcacagcctgcccgagaactgtgccagctggcagtga

SEQ ID NO: 6413 - DNA, 294 bp, synthetic construct
  misc_feature 1..294: note = Synthetic polypeptide
  source 1..294: mol_type = other DNA
ccatcaccaagcggtgagactatcacctatcgccaagtgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtg

SEQ ID NO: 6414 - DNA, 462 bp, synthetic construct
  misc_feature 1..462: note = Synthetic polypeptide
  source 1..462: mol_type = other DNA
ccatcaccaagcggtgagactatcacctatcgccaagtgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6415 - DNA, 522 bp, synthetic construct
  misc_feature 1..522: note = Synthetic polypeptide
  source 1..522: mol_type = other DNA
ccatcaccaagcggtgagactatcacctatcgccaagtgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtggtgaggattggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctga

SEQ ID NO: 6416 - DNA, 414 bp, synthetic construct
  misc_feature 1..414: note = Synthetic polypeptide
  source 1..414: mol_type = other DNA
ccatcaccaagcggtgagactatcacctatcgccaagtgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6417 - DNA, 405 bp, synthetic construct
  misc_feature 1..405: note = Synthetic polypeptide
  source 1..405: mol_type = other DNA
ccatcaccaagcggtgagactatcacctatcgccaagtgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggcaagtggggtttggagatttggtggtccatgtgtggctaggcaggggcagttga

SEQ ID NO: 6418 - DNA, 792 bp, synthetic construct
  misc_feature 1..792: note = Synthetic polypeptide
  source 1..792: mol_type = other DNA
acctctctgggcctcggtacctcagcgttgagctcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaa

SEQ ID NO: 6419 - DNA, 369 bp, synthetic construct
  misc_feature 1..369: note = Synthetic polypeptide
  source 1..369: mol_type = other DNA
acctctctgggcctcggtacctcagcgttgagctcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctga

SEQ ID NO: 6420 - DNA, 249 bp, synthetic construct
  misc_feature 1..249: note = Synthetic polypeptide
  source 1..249: mol_type = other DNA
acctctctgggcctcggtacctcagcgttgagctcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctgggtccggggatcccgagctgtcctgcagctgtaccctga

SEQ ID NO: 6421 - DNA, 369 bp, synthetic construct
  misc_feature 1..369: note = Synthetic polypeptide
  source 1..369: mol_type = other DNA
acctctctgggcctcggtacctcagcgttgagctcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcaggtccggggatcccgagctgtcctgcagctgtaccctgagaactcagagcagttggagctga

SEQ ID NO: 6422 - DNA, 843 bp, synthetic construct
  misc_feature 1..843: note = Synthetic polypeptide
  source 1..843: mol_type = other DNA
acctctctgggcctcggtacctcagcgttgagctcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagagggaaggtggagcatttgagagaaggggcatccgaggccaccagactcggaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaa

SEQ ID NO: 6423 - DNA, 1086 bp, synthetic construct
  misc_feature 1..1086: note = Synthetic polypeptide
  source 1..1086: mol_type = other DNA
tgttataggaaatagaaataaagtatttgggtagacggggagaagagagtccctggcagaaaactttccttctaacataaagtagctcagaaatagctcccttctaacctcatgcagttcaaagaaatcacttctctaactaaacaagcagcctgaaagatcaggctgtaaatcacagataaacccctggagcacagaaggagggcggggagtctcctgggtaatcaccaaacttcacaatgggccccagtaaaaacagtgggccttaataagcacattcctttccctttaggacatcaagatagagaagctaaaagtggacttggggaggtgggggtggagacgtcgtgggggaggggtgttggggggatgcctgcagctgcaagaagatgtctgggaacagacacagaaactctccctctcagataagcaaaagaaggcatcacagactaagtctgcccatgtgatccaggaataaagtgagagctgataaaaaaaaaaactctgctctataaagatagcacacctggtcccaactaaatcgtcaggccctaggaggataagacatcccctcctcactggcaccacccccgccacctgccactaactccctcctcactagcccatttataaaaaccctgacatttttactaagcaactcactcgggacccatctcttcaagggagagctgttctttctttttgcctattcaactttgctccaaactcaagtctgtgtgtgtagtgtgtgttcgcgacctccgtctccttgactgttcgaccaagagccttggtcgctacgcatttcggatctggaaacctctagaacaagttatcacagaaactgcaaagaagatttcaactcctagcttttcatcctactataaaggaggatttgaacagaaaatgagtaggcgagaagctggtcttattttaggtgtaagcccatctgctggcaaggctaagattagaacagctcataggagagtcatgattttgaatcacccagataaaggtggatctccttacgtagcagccaaaataaatgaagcaaaagacttgctagaaacaaccaccaaacattga

SEQ ID NO: 6424 - DNA, 520 bp, synthetic construct
  misc_feature 1..520: note = Synthetic polypeptide
  source 1..520: mol_type = other DNA
gtacagtgattaatagcccaaattccagagttgaactgcctccatctggatccttactttactctgcatgtagtaggcaatcttaggtcaagaaagatttggaaacatgacgagggtctattaccgagaagctatgggtgcatttattgtcttcgatgtcaccaggccagccacatttgaagcagtggcaaagtggaaaaatgatttggactccaagttaagtctccctaatggcaaaccggtttcagtggttttgttggccaacaaatgtgaccaggggaaggatgtgctcatgaacaatggcctcaagatggaccagttctgcaaggagcacggtttcgtaggatggtttgaaacatcagcaaaggaaaatataaacattgatgaagcctccagatgcctggtgaaacacatacttgcaaatgagtgtgacctaatggagtctattgagccggacgtcgtgaagccccatctcacatcaaccaaggttgccagctgctctggctgtgccaaatcctag

SEQ ID NO: 6425 - DNA, 496 bp, synthetic construct
  misc_feature 1..496: note = Synthetic polypeptide
  source 1..496: mol_type = other DNA
aaaatctgactttttcagcacagacatgacaaagtaaatgctcattgaagcatttcagattttgggtttttggagtagggatgctcaactgctcatgatggagcagtccaagaagtcctccctcatggtggcccgcagtattctcaacaacaagctcatcagcaagaagctggagcgctacctgaagggcgagaaccctttcaccgacagccccgaggaggagaaggagcaggaggaggctgagggcggtgccctggacgagggggcgcagggcgaagcggcagggatctcggagggcgcagagggcgtgccggcgcagcctcccgtgcccccagagccagcccccggggccgtgtcgccgccaccgccgccgcccccagaggaggaggaggagggcgccgtgcccttgctgggaggggcgctgcaacgccagatccgcggcatcccgggcctcgacgtggaggacgacgaggagggcggcgggggcgccccgtga

SEQ ID NO: 6426 - DNA, 2157 bp, synthetic construct
  misc_feature 1..2157: note = Synthetic polypeptide
  source 1..2157: mol_type = other DNA
aagggcaaactggcacagtggaaggagtcgggcagatccagggcggactcctggcgccgccgcccactctcagtgaccatggacccttcacgttctgagccagtttcttcgactgcaaactggggcccgtaatagcgcccgcctcccggttctgagtattctagaggtccaccgggagagcggggccccccgggtcccccgggaccgccgggagtgcctggatccgacggcatcgacggtgacaatgggccccctggaaaagctggccctccgggacccaagggcgagcctggcaaagctgggccagatgggccagacgggaagcccgggattgatggtttaactggagccaagggggagcctggccccatggggatccctggagtcaagggccagcccgggcttcctggtcctcctggccttccgggccctggttttgctggacctcctgggcctcctggacctgttggcctccctggtgagattggaatccgaggccccaagggggaccctggaccagatggaccatcggggcccccaggaccccctgggaaacctggtcgcccgggaaccatccagggtctggaaggcagtgcggatttcctgtgtccaaccaactgtccacccggaatgaaaggtcccccagggctgcagggagtgaaggggcatgcgggcaaacgcgggattctgggtgatcctggccaccaggggaagccgggtcccaagggagatgtgggtgcctctggagagcaaggcatccctggaccaccgggtccccagggcatcaggggctacccaggcatggcagggcccaagggagagacgggccctcatggatataaaggcatggtgggcgctatcggtgccactgggccaccgggtgaggaaggtcctaggggaccgccaggccgagctggggagaagggtgacgagggcagcccaggtattcgtggaccccaggggatcacaggcccgaaaggagcaacgggccccccaggcatcaacggcaaggatgggaccccaggcacgcctggcatgaagggcagtgcaggacaggcgggacagcccggaagtccaggccaccagggcctagcgggtgtgccaggccagcctgggacaaaaggaggccctggagaccagggtgagccgggcccgcagggccttcctggattctctggtccccctgggaaagagggagagccagggcctcgaggagaaattggtccccagggcatcatgggacagaagggtgaccaaggcgagaggggtccagtggggcaaccaggccctcagggaaggcagggccctaagggggagcagggcccccccggaattccagggccccaaggcttgccaggcgtcaaaggagacaagggctccccagggaagaccgggccccgcggcaaagtgggtgacccaggggtggccggcctccccggagagaaaggcgagaagggcgagtccggcgagccggggcccaagggacagcaaggagtacgtggagaacccggctaccctggccccagcggggatgcgggcgccccaggggttcagggctaccctggtccccccggccctcgaggactggccgggaaccgaggcgtgccaggacagcccgggagacagggcgtggagggccgggatgccactgaccagcacatcgtggatgtggcgctgaagatgctgcaagagcaactggcagaggtcgccgtgagtgccaagcgggaagccctgggtgcggtgggcatgatgggtcctccaggacctcctgggccccctgggtacccaggcaagcagggcccccatgggcaccctggccctcggggcgttcctggcatcgtgggagccgtgggtcagatcggcaacacggggcccaagggaaaacgtggagagaagggtgatccaggagaagtgggacgggggcaccccgggatgcctgggcccccagggatcccaggactccctggccggcctggccaggcaatcaacggcaaggatggagatcgagggtccccaggggctccaggagaggcaggtcgacctggcctgccaggccccgtggggctgccgggcttctgtgaacctgccgcctgccttggagcttcggcctatgcctctgcccgccttacagagcctggatccatcaaggggccttga

SEQ ID NO: 6427 - DNA, 799 bp, synthetic construct
  misc_feature 1..799: note = Synthetic polypeptide
  source 1..799: mol_type = other DNA
aagggcaaactggcacagtggaaggagtcgggcagatccagggcggactcctggcgccgccgcccactctcagtgaccatggacccttcacgttctgagccagtttcttcgactgcaaactggggcccgtaatagcgcccgcctcccggttctgagtattctagaggtccaccgggagagcggggccccccgggtcccccgggaccgccgggagtgcctggatccgacggcatcgacggtgacaatgggccccctggaaaagctggccctccgggacccaagggcgagcctggcaaagctgggccagatgggccagacgggaagcccgggattgatggtttaactggagccaagggggagcctggccccatggggatccctggagtcaagggccagcccgggcttcctggtcctcctggccttccgggccctggttttgctggacctcctgggcctcctggacctgttggcctccctggtgagattggaatccgaggccccaagggggaccctggaccagatggaccatcggggcccccaggaccccctgggaaacctggtcgcccgggaaccatccagggtctggaaggcagtgcggatttcctgtgtccaaccaactgtccacccggaatgaaaggtcccccagggctgcagggagtgaaggggcatgcgggcaaacgcgggattctgggtgatcctggccaccaggggaagccgggtcccaagggagatgtgggtgcctctggagagcaaggcatccctggaccaccgggtccccagggcatcaggggctacccag

SEQ ID NO: 6428 - DNA, 336 bp, synthetic construct
  misc_feature 1..336: note = Synthetic polypeptide
  source 1..336: mol_type = other DNA
aagggcaaactggcacagtggaaggagtcgggcagatccagggcggactcctggcgccgccgcccactctcagtgaccatggacccttcacgttctgagccagtttcttcgactgcaaactggggcccgtaatagcgcccgcctcccggttctgagtattctagaggtccaccgggagagcggggccccccgggtcccccgggaccgccgggagtgcctggatccgacggcatcgacgggcctcctggacctgttggcctccctggtgagattggaatccgaggccccaagggggaccctggaccagatggaccatcggggcccccaggaccccct

SEQ ID NO: 6429 - DNA, 369 bp, synthetic construct
  misc_feature 1..369: note = Synthetic polypeptide
  source 1..369: mol_type = other DNA
gcggtttcatttacccaattgttgcggtatggaagtacttgtgttcagccagcttaccaaaacctgaggcagaaagtggataattttgtgtcaacacatctggacaagcaggaatggaatcctacgatgaacaaaaaccagttgcgaaatggtctgaggcagagtgtggttcagtcagggatgttggaagctggagtagacaggattatttctcaggtggtggatccaaaacttaaccacatcttcaggccacaaatagaacgagcaattcatgagttcctggcggcccagaaaaaagcagctgtgccagcaccccctccagagcccgaaggccaggaccctccagctccatctcaggacacttcctaa

SEQ ID NO: 6430 - DNA, 201 bp, synthetic construct
  misc_feature 1..201: note = Synthetic polypeptide
  source 1..201: mol_type = other DNA
gcggtttcatttacccaattgttgcggtatggaagtacttgtgttcagccagcttaccaaaacctgaggcagaaagtggataattttgtgtcaacacatctggacaagcaggaatggaatcctacgatgaacaaaaaccagttgcgaaatggtctgaggcagagtgtggttcaaatacgccagacaccttttgaaagctaa

SEQ ID NO: 6431 - DNA, 2274 bp, synthetic construct
  misc_feature 1..2274: note = Synthetic polypeptide
  source 1..2274: mol_type = other DNA
agctgggggaccttgggcatgccatttcacctctctgtcctctcctgtaaaacgggcgtcatgatttttgccttgtaggggggaccatgagaataaaaatgttttgaaaatagcaaagacataactaagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtgggggtagaggcccacagggtgacaaggccatcagggagcaaggccccagggagcaggagccagaactcagcttcctgaagcagaaggaacagctggaggctgaggcacaggcattaaggcaagagttagagaggcagcgacggctgctggggtctgtacagcaggatctggagaggagcttgcaggatgccagccgcggggacccagctcatgctggcttggctgagctgggccacagattggcccagaaactgcagggcctggagaactggggccaggaccctggggtctctgccaatgcctcaaaggcctggcaccagaagtcccacttccagaattctagggagtggagtggaaaggaaaagtggtgggatgggcagagagaccggaaggctgagcactggaaacataagaaggaagaatctggccgggaaaggaagaagaactggggaggtcaggaggacagggagccagcaggaaggtggaaggagggcaggccaagggtggaggagtcggggagcaagaaggagggcaagcgacagggcccgaaggaacccccaaggaaaagtggtagcttccactcctctggagaaaagcagaagcaacctcggtggagggaagggactaaggacagccatgaccccctgccatcctgggcagagctgttgaggcccaagtaccgggcaccccagggctgctcaggtgtggacgagtgtgcccggcaggagggcctgactttctttggcacagagctagccccagtgcggcaacaggagctggcctctctgctaagaacatacttggcacggctgccctgggctgggcagctgaccaaggagctacccctctcacctgctttctttggtgaggatggcatcttccgtcatgaccgcctccgcttccgggattttgtggatgccctggaggacagcttggaggaggtggctgtgcaacagacaggtgatgatgatgaagtagatgactttgaggacttcatcttcagccacttctttggagacaaagcactgaagaagaggtcagggaagaaggacaagcactcacagagcccaagagctgcggggcccagggaggggcacagccatagccaccaccaccaccaccggggctga

SEQ ID NO: 6432 - DNA, 1026 bp, synthetic construct
  misc_feature 1..1026: note = Synthetic polypeptide
  source 1..1026: mol_type = other DNA
agctgggggaccttgggcatgccatttcacctctctgtcctctcctgtaaaacgggcgtcatgatttttgccttgtaggggggaccatgagaataaaaatgttttgaaaatagcaaagacataactaagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggtgggcacaggcaggaggggctgggctagggtaacccacctaggccaggcgtctgtcctagcatcctcccccaaaaggaatgtttcctatttacccacacatcctgaccctcccctctcccactatagtcagggcgtcttcccagttcttggttcacatcccttgtgctaa

SEQ ID NO: 6433 - DNA, 522 bp, synthetic construct
  misc_feature 1..522: note = Synthetic polypeptide
  source 1..522: mol_type = other DNA
agctgggggaccttgggcatgccatttcacctctctgtcctctcctgtaaaacgggcgtcatgatttttgccttgtaggggggaccatgagaataaaaatgttttgaaaatagcaaagacataactaagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagtcacctcactgccctgtccctgtcctttcccctag

SEQ ID NO: 6434 - DNA, 947 bp, synthetic construct
  misc_feature 1..947: note = Synthetic polypeptide
  source 1..947: mol_type = other DNA
gccgggtgcagtggctcacgcctgtaatcccagcactttaggaggccaaggcggatggatcacgaggtcaggaattcaagaccagcctgaccaagatggtgaaaccctgtctctactaaaactacaaaaattagccaggcgcagtggcaggcgcctataatcccagctactcgggaggctgaggcaggagaatcacttgaacccaggtggcagaggttgcagtgagccaagatcacgccgctgcattccagcctcggcaacagactgcatcagatctgttgctgcactcagcactggtgcaggagaccgcctacatcgaagaccggcccctgcatatgttgtactgtgctgcggaagagaactgcctggccagctcagcccgctcagccaactggccctatggtcaccggcgtctgctccgattctcctcccagatccacaacctgggacgagctgacttcaggcccaaggctgggcgccactcctgggtgtggcacgagtgccatgggcattaccacagcatggacatcttcactcactatgatatcctcaccccaaatggcaccaaggtggctgagggccacaaagctagtttctgtctcgaagacactgagtgtcaggaggatgtctccaagcggtatgagtgtgccaactttggagagcaaggcatcactgtgggttgctgggatctctaccggcatgacattgactgtcagtggattgacatcacggatgtgaagccaggaaactacattctccaggttgtcatcaacccaaactttgaagtagcagagagtgactttaccaacaatgcaatgaaatgtaactgcaaatatgatggacatagaatctgggtgcacaactgccacattggtgatgccttcagtgaagaggccaacaggaggtttgaacgctaccctggccagaccagcaaccagattatctaa

SEQ ID NO: 6435 - DNA, 881 bp, synthetic construct
  misc_feature 1..881: note = Synthetic polypeptide
  source 1..881: mol_type = other DNA
gccgggtgcagtggctcacgcctgtaatcccagcactttaggaggccaaggcggatggatcacgaggtcaggaattcaagaccagcctgaccaagatggtgaaaccctgtctctactaaaactacaaaaattagccaggcgcagtggcaggcgcctataatcccagctactcgggaggctgaggcaggagaatcacttgaacccaggtggcagaggttgcagtgagccaagatcacgccgctgcattccagcctcggcaacagactgcatcagatctgttgctgcactcagcactggtgcaggagaccgcctacatcgaagaccggcccctgcatatgttgtactgtgctgcggaagagaactgcctggccagctcagcccgctcagccaactggccctatggtcaccggcgtctgctccgattctcctcccagatccacaacctgggacgagctgacttcaggcccaaggctgggcgccactcctgggtgtggcacgagtgccatgggcattaccacagcatggacatcttcactcactatgatatcctcaccccaaatggcaccaaggtggctgagggccacaaagctagtttctgtctcgaagacactgagtgtcaggaggatgtctccaagcggtatgagtgtgccaactttggagagcaaggcatcactgtgggttgctgggatctctaccggcatgacattgactgtcagtggattgacatcacggatgtgaagccaggaaactacattctccaggttgtcatcaacccaaactttgaagtagcagagagtgactttaccaacaatgcaatgaaatgtaactgcaaatatgatggacatagaatctgggtgcacaactgccacattggtatttga

SEQ ID NO: 6436 - DNA, 457 bp, synthetic construct
  misc_feature 1..457: note = Synthetic polypeptide
  source 1..457: mol_type = other DNA
gagtgatgctgaggcaggagtacctgccaattgatgaggcagagacctggggtcagggctgcttgcccaacctctgcttagctgtttgaccttggcctggttacactgtctgtctctgagcttctagtttctcatctgcaaaaacatgaggaatgggggtggttcgtgttggtcgtctcagagagtcctcctgagctggcatgctggaggctctggcattcatcgccctgtggccaagaaggctatgcctggggctgaatacaaggccaagaaagcaaaaggtgatgtgaagaagaaaggccggccggatccctatgcctacatccccctcaacagaagcaagctcaaccgcaggaagaagatgaagctgcagggacagttcaaaggcctggtgaaggctgcccggcgaggttcccaggtgggacacaaaaaccgcagaaaggatcgtcgaccctga

SEQ ID NO: 6437 - DNA, 850 bp, synthetic construct
  misc_feature 1..850: note = Synthetic polypeptide
  source 1..850: mol_type = other DNA
ttagagccctagacttctttgtttgaaagatacctgctggactagcagtctttcttcctgtctctctctgtctggagggaggattgatccctgacttcctgggttggtagtttttcttcctggctctcagtcttgagtgggaaatttttcttggctctttgtgaggcctctccattctctctattttatcctgtttctctcatggaaaattctcagttggctgaaactcccttcttgaactcctactgactatatgctctaccaatctgtccacctccttcctgttggcataaatttgcagagaataatttggaacttcattgtcctctttgggaaacttatgatctccccaaactggcttctgtaaggcctctcccttcccattcctcctttgttctttaaccacttttgatcttcccttcagcgaccttgaagcctttgatatatcccccttttaactctaccaccttcatccctctgttcattctgccaggcttttcatttcccacttcaacctctcagctcccaacagtcacttgaactatagaccccttggcctccattgggggctctccttaagagactgagggatccctgagggatccccaaaagcaatgattagaggctgaaaacagaaaaaaaactttggaaacagactggatgttttgtacactcagctggtcctgctgatgatgaagcccctgatgctgaaaccactgctgctgcaaccactgcaaccactgctgctcctaccactgcaaccaccgctgcttctaccactgctcgtaaagacattccagttttacccaaatgggttggggatctcccgaatggtagagtgtgtccctga

SEQ ID NO: 6438 - DNA, 1025 bp, synthetic construct
  misc_feature 1..1025: note = Synthetic polypeptide
  source 1..1025: mol_type = other DNA
gggttggagccccagccacgtcatcagctccctgggacccctgcgtgagacgtgagaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctag

SEQ ID NO: 6439 - DNA, 857 bp, synthetic construct
  misc_feature 1..857: note = Synthetic polypeptide
  source 1..857: mol_type = other DNA
gggttggagccccagccacgtcatcagctccctgggacccctgcgtgagacgtgagaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaag

SEQ ID NO: 6440 - DNA, 581 bp, synthetic construct
  misc_feature 1..581: note = Synthetic polypeptide
  source 1..581: mol_type = other DNA
gggttggagccccagccacgtcatcagctccctgggacccctgcgtgagacgtgagaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctg

SEQ ID NO: 6441 - DNA, 317 bp, synthetic construct
  misc_feature 1..317: note = Synthetic polypeptide
  source 1..317: mol_type = other DNA
gggttggagccccagccacgtcatcagctccctgggacccctgcgtgagacgtgagaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcgga

SEQ ID NO: 6442 - DNA, 294 bp, synthetic construct; identical to SEQ ID NO: 6413
  misc_feature 1..294: note = Synthetic polypeptide
  source 1..294: mol_type = other DNA

SEQ ID NO: 6443 - DNA, 462 bp, synthetic construct; identical to SEQ ID NO: 6414
  misc_feature 1..462: note = Synthetic polypeptide
  source 1..462: mol_type = other DNA

SEQ ID NO: 6444 - DNA, 522 bp, synthetic construct; identical to SEQ ID NO: 6415
  misc_feature 1..522: note = Synthetic polypeptide
  source 1..522: mol_type = other DNA

SEQ ID NO: 6445 - DNA, 414 bp, synthetic construct; identical to SEQ ID NO: 6416
  misc_feature 1..414: note = Synthetic polypeptide
  source 1..414: mol_type = other DNA

SEQ ID NO: 6446 - DNA, 405 bp, synthetic construct; identical to SEQ ID NO: 6417
  misc_feature 1..405: note = Synthetic polypeptide
  source 1..405: mol_type = other DNA

SEQ ID NO: 6447 - DNA, 80 bp, synthetic construct; identical to SEQ ID NO: 6364
  misc_feature 1..80: note = Synthetic polypeptide
  source 1..80: mol_type = other DNA

SEQ ID NO: 6448 - DNA, 217 bp, synthetic construct; identical to SEQ ID NO: 6365
  misc_feature 1..217: note = Synthetic polypeptide
  source 1..217: mol_type = other DNA

SEQ ID NO: 6449 - DNA, 250 bp, synthetic construct
  misc_feature 1..250: note = Synthetic polypeptide
  source 1..250: mol_type = other DNA
gagcatggacatcgtatttatgagaaataggcatggaatcctagctctgccgtgtattggctggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtg

SEQ ID NO: 6450 - DNA, 418 bp, synthetic construct
  misc_feature 1..418: note = Synthetic polypeptide
  source 1..418: mol_type = other DNA
gagcatggacatcgtatttatgagaaataggcatggaatcctagctctgccgtgtattggctggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6451 - DNA, 478 bp, synthetic construct
  misc_feature 1..478: note = Synthetic polypeptide
  source 1..478: mol_type = other DNA
gagcatggacatcgtatttatgagaaataggcatggaatcctagctctgccgtgtattggctggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtggtgaggattggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctga

SEQ ID NO: 6452 - DNA, 370 bp, synthetic construct
  misc_feature 1..370: note = Synthetic polypeptide
  source 1..370: mol_type = other DNA
gagcatggacatcgtatttatgagaaataggcatggaatcctagctctgccgtgtattggctggaggggtgctgtcatcctggtctcttccattgcagcttataatccagtagtggcgctgggtgtctacaatgtcagcaagacagcgctgctgggtctcactagaacactggcattggagctggcccccaaggacatccggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6453 - DNA, 361 bp, synthetic construct
  misc_feature 1..361: note = Synthetic polypeptide
  source 1..361: mol_type = other DNA
gagcatggacatcgtatttatgagaaataggcatggaatcctagctctgccgtgtattggctggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggcaagtggggtttggagatttggtggtccatgtgtggctaggcaggggcagttga

SEQ ID NO: 6454 - DNA, 2248 bp, synthetic construct
  misc_feature 1..2248: note = Synthetic polypeptide
  source 1..2248: mol_type = other DNA
tttcttggttccctgaccaggaagcgaggtgattaacggatggttgaggcagctccttaggcgactttagcctgccctgtggaacatccctgcgggggactccaaccagccaaagcaacgcggatcctgagagtgctcctgggtaggcacttgccctgatgggacgccttgccagagcagtgtgtggcaggcccccgtggaggatcagcacagtggctgaacaccaggaaggaactggcatttggagtctggacatctaaaacttgaccacaggcggagcagcagcagccggagccaggactctgcggaggggcaggacgggcaggtcccagagcagttctcaggcctcctccacggctcctccccggtgtgcgaggtggggcaggaccctttccagctgctctgtaccgctggccagagccatccagacgggtccccccagcagggcgcctgccacaaggccagcatgcagctggaggagacgggtgtgcatgctcctggagcctcccagcccagtgccctggaccagagcaagagagtgggctacctcacaggcctgcccaccaccaacagccgctcgcaccctgaaactttgactcacacagcatctccgcaccctggtggtgctgaggaaggagaccggagtggggccaggagccgagcgcctcccactagcaaacccaaagctgaactcaaactcagccgcagcttgtccaagtctgactctgatctcctgacctgctcacccacagaggacgctaccatggggagtcggagtgagtccttatccaactgcagcattgggaagaaaaggctagagaagtcaccctccttcgcctcggagtgggatgagattgagaaaatcatgagttctattggagaagggattgacttttctcaggaacggcagaagatctcaggtttacggacgctggagcagagtgtcggggagtggctggagtcgattgggctgcagcagtatgagagcaagttgcttctgaatggctttgacgatgtccacttcctggggtctaatgtgatggaagagcaggacctgcgggacatcggcatcagcgacccacagcaccggcggaagctgctccaggcggcacgctccctacccaaggtgaaggctctgggttatgacgggaacagcccccctagcgtgccctcctggctggactccctggggctgcaggactacgtccattccttcttgtcaagtggttacagctccattgacaccgtgaagaacctctgggagctagagctcgtcaatgtcctgaaggtccagctgctcggccatcgcaagcgcatcatcgcctccctcgcagacagaccgtacgaggagccgccccagaagccccccagattctcccagctgaggtgccaagatttgctctcccagacgtcatccccactgagtcagaatgattcctgcactgggcggtcggcagatctgctgctgcctccaggggacacaggcaggaggcgccatgacagtctccatgaccctgcggcaccctcccgagcggagcgcttcaggatccaggaggagcaccgtgaggccaagctgaccctgcggcccccgagcctggcagccccctacgccccagtgcagagttggcaacaccagccagagaaactcatcttcgagtcctgtggttatgaagccaattatctgggctccatgctgatcaaagatctgcgagggacagaatccacgcaagacgcctgtgccaagatgcggaaatctacggagcacatgaagaagatccccaccatcatcctgtccatcacatacaaaggtgtcaagttcatcgatgcctccaacaagaacgtcattgcagagcacgagatccggaacatttcctgtgcggcccaggacccggaggacctctgtacctttgcctacatcaccaaggacctgcagaccagccaccactattgccatgtgttcagcaccgtggatgtgaacctgacctacgagatcatcctgacgctggggcaggccttcgaagtggcctatcagttggccctgcaggcccagaagtccagggcgacgggcgcctctgcagctgagatgattgaaacaaaatcttccaaaccggtgcctaagcctcgggtcggcgtgaggaaatccgcactggaaccacctgatatggaccaagatgcccaatcccatgccagtgtctcctgggttgtggaccccaaaccagactctaagcggagcctcagcaccaactga

SEQ ID NO: 6455 - DNA, 382 bp, synthetic construct; identical to SEQ ID NO: 434
  misc_feature 1..382: note = Synthetic polypeptide
  source 1..382: mol_type = other DNA

SEQ ID NO: 6456 - DNA, 396 bp, synthetic construct
  misc_feature 1..396: note = Synthetic polypeptide
  source 1..396: mol_type = other DNA
ccatcaccaagcggtgagactatcacctatcgccaagtggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtg

SEQ ID NO: 6457 - DNA, 564 bp, synthetic construct
  misc_feature 1..564: note = Synthetic polypeptide
  source 1..564: mol_type = other DNA
ccatcaccaagcggtgagactatcacctatcgccaagtggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6458 - DNA, 624 bp, synthetic construct
  misc_feature 1..624: note = Synthetic polypeptide
  source 1..624: mol_type = other DNA
ccatcaccaagcggtgagactatcacctatcgccaagtggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtggtgaggattggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctga

SEQ ID NO: 6459 - DNA, 516 bp, synthetic construct
  misc_feature 1..516: note = Synthetic polypeptide
  source 1..516: mol_type = other DNA
ccatcaccaagcggtgagactatcacctatcgccaagtggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6460 - DNA, 507 bp, synthetic construct
  misc_feature 1..507: note = Synthetic polypeptide
  source 1..507: mol_type = other DNA
ccatcaccaagcggtgagactatcacctatcgccaagtggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggcaagtggggtttggagatttggtggtccatgtgtggctaggcaggggcagttga

SEQ ID NO: 6461 - DNA, 163 bp, synthetic construct; identical to SEQ ID NO: 480
  misc_feature 1..163: note = Synthetic polypeptide
  source 1..163: mol_type = other DNA

SEQ ID NO: 6462 - DNA, 104 bp, synthetic construct; identical to SEQ ID NO: 481
  misc_feature 1..104: note = Synthetic polypeptide
  source 1..104: mol_type = other DNA

SEQ ID NO: 6463 - DNA, 201 bp, synthetic construct
  misc_feature 1..201: note = Synthetic polypeptide
  source 1..201: mol_type = other DNA
gaaataaaatcaacaggtaacactggagctgactccctgggaagagaggccaaatgttacaatgaacttaatggatgcaccaagatatatgaccctgtctgtgggactgatggaaatacttatcccaatgaatgcgtgttatgttttgaaaatcggaaacgccagacttctatcctcattcaaaaatctgggccttgctga

SEQ ID NO: 6464 - DNA, 159 bp, synthetic construct
  misc_feature 1..159: note = Synthetic polypeptide
  source 1..159: mol_type = other DNA
gaaataaaatcaacaggtaacactggagctgactccctgggaagagaggccaaatgttacaatgaacttaatggatgcaccaagatatatgaccctgtctgtgggactgatggaaatacttatcccaatgaatgcgtgttatgttttgaaaatcggtga

SEQ ID NO: 6465 - DNA, 694 bp, synthetic construct
  misc_feature 1..694: note = Synthetic polypeptide
  source 1..694: mol_type = other DNA
ccttcctcttggtcctctgactctgcccacctccttccttttgtcccccgctgccaacgtcatcctctccaattccgctccctctcctccccagccctcaccttggagcctcccatgaggggccttgcttgctcttgattttgtgactgtgatcatctctgccccatgcacacattttatttcccatgtgagactgctcagatacttttttgtcttctccttgcatcctctgagagcactggacacagtgccagacacactggagaatgggggcgacatggtccacctgaaagatcttaacacccaggctgtgagatttgggctgctctttaaccaggagaatacaacttattcgaaaacgattgctctatatggattcttctttaagataaagggactcaaacatgatactacctcttatagtttttacatgcagagaataaagcacacagacctggaatctccctctgcggtctacgagcacaaccacgtcagcctgcgagcggcacgcctggtgaagtatgagatcagagcagaggccctggttgacggcaagtggcaggagttcaggacaaaccagatcaagcagaagtttgggttgaccacgtcatcctgcaaaagccataccttgaaaatccaaactgtgggcatcccaatctatgtaagttttgcattcatcttcccagcatcttga

SEQ ID NO: 6466 - DNA, 871 bp, synthetic construct; identical to SEQ ID NO: 437
  misc_feature 1..871: note = Synthetic polypeptide
  source 1..871: mol_type = other DNA

SEQ ID NO: 6467 - DNA, 421 bp, synthetic construct; identical to SEQ ID NO: 441
  misc_feature 1..421: note = Synthetic polypeptide
  source 1..421: mol_type = other DNA

SEQ ID NO: 6468 - DNA, 638 bp, synthetic construct; identical to SEQ ID NO: 442
  misc_feature 1..638: note = Synthetic polypeptide
  source 1..638: mol_type = other DNA

SEQ ID NO: 6469 - DNA, 337 bp, synthetic construct; identical to SEQ ID NO: 443
  misc_feature 1..337: note = Synthetic polypeptide
  source 1..337: mol_type = other DNA

SEQ ID NO: 6470 - DNA, 742 bp, synthetic construct; identical to SEQ ID NO: 6357
  misc_feature 1..742: note = Synthetic polypeptide
  source 1..742: mol_type = other DNA

SEQ ID NO: 6471 - DNA, 590 bp, synthetic construct; identical to SEQ ID NO: 6358
  misc_feature 1..590: note = Synthetic polypeptide
  source 1..590: mol_type = other DNA

SEQ ID NO: 6472 - DNA, 577 bp, synthetic construct; identical to SEQ ID NO: 6359
  misc_feature 1..577: note = Synthetic polypeptide
  source 1..577: mol_type = other DNA

SEQ ID NO: 6473 - DNA, 430 bp, synthetic construct; identical to SEQ ID NO: 6360
  misc_feature 1..430: note = Synthetic polypeptide
  source 1..430: mol_type = other DNA

SEQ ID NO: 6474 - DNA, 670 bp, synthetic construct; identical to SEQ ID NO: 6361
  misc_feature 1..670: note = Synthetic polypeptide
  source 1..670: mol_type = other DNA

SEQ ID NO: 6475 - DNA, 665 bp, synthetic construct; identical to SEQ ID NO: 6374
  misc_feature 1..665: note = Synthetic polypeptide
  source 1..665: mol_type = other DNA

SEQ ID NO: 6476 - DNA, 518 bp, synthetic construct; identical to SEQ ID NO: 6375
  misc_feature 1..518: note = Synthetic polypeptide
  source 1..518: mol_type = other DNA

SEQ ID NO: 6477 - DNA, 285 bp, synthetic construct
  misc_feature 1..285: note = Synthetic polypeptide
  source 1..285: mol_type = other DNA
cagaggaagaggccgtggagctgacgcctggagtcaggctgtactcaggggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataa

SEQ ID NO: 6478 - DNA, 3021 bp, synthetic construct; identical to SEQ ID NO: 449
  misc_feature 1..3021: note = Synthetic polypeptide
  source 1..3021: mol_type = other DNA

SEQ ID NO: 6479 - DNA, 3075 bp, synthetic construct; identical to SEQ ID NO: 450
  misc_feature 1..3075: note = Synthetic polypeptide
  source 1..3075: mol_type = other DNA

SEQ ID NO: 6480 - DNA, 1143 bp, synthetic construct; identical to SEQ ID NO: 451
  misc_feature 1..1143: note = Synthetic polypeptide
  source 1..1143: mol_type = other DNA

SEQ ID NO: 6481 - DNA, 414 bp, synthetic construct
  misc_feature 1..414: note = Synthetic polypeptide
  source 1..414: mol_type = other DNA
ggcggcggcggagcgggcggcggagcggcggcagcagcgaccgcgctgagcacgttcttccaagaaaccaacattcccaacagccaccaccaccaccagatgatgtgcactcccagcaacacccctgccacgccgcccaacttccccgatgcgctggccatgttctccaagctccgcgcctccgagggcctgcagagcagcaacagccccatgacagccgcagcctgctccccacctgcaaacttcagccccttctgggcctcgtccccgcccagccaccaggcgccctggatcccgccctcctcccccaccaccttccaccacctccaccgcccacagcccacgtggcccccaggagcacagcaggggggcgcccagcagaaagccatggcggccatggacggccagagatga

SEQ ID NO: 6482 - DNA, 368 bp, synthetic construct
  misc_feature 1..368: note = Synthetic polypeptide
  source 1..368: mol_type = other DNA
ggccaggcgtgggggctcatgcctgtaattccagcacttcgggaggccgaggcaggcggatcacccgagtgtttgattgcatcgaggtctatgcccctggcttcaaggactctgtggttggcagagacatcctcacaccaccagatttggagagaatcttcgggcttcctggagggaacatattccactgcgccatgtccctggaccagctctacttcgcccgccccgtgcccctgcattctggctaccgctgccctctccagggcctgtatctctgtggaagtggggctcatcctggaggaggtgtgatgggagctgctgggcgaaatgcagcacatgtggcctttagggacctcaagagcatgtga

SEQ ID NO: 6483 - DNA, 337 bp, synthetic construct; identical to SEQ ID NO: 6393
  misc_feature 1..337: note = Synthetic polypeptide
  source 1..337: mol_type = other DNA

SEQ ID NO: 6484 - DNA, 326 bp, synthetic construct
  misc_feature 1..326: note = Synthetic polypeptide
  source 1..326: mol_type = other DNA
acttaagcactgccctgctgtgctactcctgcaaagcccaggtgagcaacgaggactgcctgcaggtggagaactgcacccagctgggggagcagtgctggaccgcgcgcatccgcgcagttggcctcctgaccgtcatcagcaaaggctgcagcttgaactgcgtggatgactcacaggactactacgtgggcaagaagaacatcacgtgctgtgacaccgacttgtgcaacgccagcggggcccatgccctgcagccggctgctgccatccttgcgctgctccctgcactcggcctgctgctctggggacccggccagctctag

SEQ ID NO: 6485 - DNA, 146 bp, synthetic construct
  misc_feature 1..146: note = Synthetic polypeptide
  source 1..146: mol_type = other DNA
acttaagcactgccctgctgtgctactcctgcaaagcccaggtgagcaacgaggactgcctgcaggtggagaactgcacccagctgggggagcagtgctggaccgcgcgcatccgtgagtggggggacgacagccgccaggcctag

SEQ ID NO: 6486 - DNA, 769 bp, synthetic construct
  misc_feature 1..769: note = Synthetic polypeptide
  source 1..769: mol_type = other DNA
gaactcgggcaagttatttaacacccctgagcttctttcttcatctgcaaaatggaacccctccccttcctttgaattgctgagcccattacgcgaggtgacggcggaatcccgctgtaagctgctcagctggctgatcccggtgcaccgccaattcggcctctccttcgagtcgctgtgcctgacggtgaacactctggaccgcttcctcaccaccacgccggtggctgcagactgcttccagctgcttggggtcacctccttgctcatcgcttgcaaacaggtggaggtgcacccgccgcgcgtgaagcagcttctggccctctgctgcggcgccttctcccggcagcagctctgcaacctcgagtgcatcgtgctgcacaagctgcacttcaccctgggtgcgcccaccattagcttcttcctggagcatttcacgcacgctcgcgtggaggcggggcaggctgaggcctccgaagctctggaagcgcaagccctggcgcggggggtggcagagctgagtctggccgactatgccttcaccagctactccccttccctcctggcgatctgctgcctggcgctggcggaccgcatgctgcgggtctcgcggcccgtggacttgcgactgggagaccacccggaggcggcgctggaggactgtatgggcaagttgcagctgctggtggccataaacagtacttccttgactcacatgctgcccgttcagatctgcgagaagtgcagcctgcccccgagctcgaaataa

SEQ ID NO: 6487 - DNA, 1148 bp, synthetic construct; identical to SEQ ID NO: 436
  misc_feature 1..1148: note = Synthetic polypeptide
  source 1..1148: mol_type = other DNA

SEQ ID NO: 6488 - DNA, 431 bp, synthetic construct
  misc_feature 1..431: note = Synthetic polypeptide
  source 1..431: mol_type = other DNA
caaaaaggcagctatgtagggtggaaagaacagatgaggtgtctggccagctcattctcaccaacctctccctgacctcctcgggcacctaccgctgtgtggccaccaaccagatgggcagtgcatcctgtgagctgaccctctctgtgaccgaaccctcccaaggccgagtggccggagctctgattggggtgctcctgggcgtgctgttgctgtcagttgctgcgttctgcctggtcaggttccagaaagagagggggaagaagcccaaggagacatatgggggtagtgaccttcgggaggatgccatcgctcctgggatctctgagcacacttgtatgagggctgattctagcaaggggttcctggaaagaccctcgtctgccagcaccgtgacgaccaccaagtccaagctccctatggtcgtgtga

SEQ ID NO: 6489 - DNA, 302 bp, synthetic construct
  misc_feature 1..302: note = Synthetic polypeptide
  source 1..302: mol_type = other DNA
caaaaaggcagctatgtagggtggaaagaacagatgaggtgtctggccagctcattctcaccaacctctccctgacctcctcgggcacctaccgctgtgtggccaccaaccagatgggcagtgcatcctgtgagctgaccctctctgtgaccgaaccctcccaaggccgagtggccggagctctgattggggtgctcctgggcgtgctgttgctgtcagttgctgcgttctgcctggtcaggttccagaaagagagggggaagaagcccaaggagacatatgggggtagtgaccttcggtga

SEQ ID NO: 6490 - DNA, 330 bp, synthetic construct
  misc_feature 1..330: note = Synthetic polypeptide
  source 1..330: mol_type = other DNA
ttagatgagataaggagttattactaattttgttaggtgtgacaatgacatagtagttttgtaactactgtcattactatatcaagtactatatcaataatgataaggtctttatcatttggaacttgtaggtgacatgacatgagaattgccttaaaatactcaaggaaaaaaatcctactgctgggtgtgggaggtgcttgatgaaatgagatctgcaaattgttaatagtgattcctgagtgagcacatatacagtactgtagtcttgaagagaaaattcagtctccaacagaagaaacagaaatcttttatcacagaggggtgtag

SEQ ID NO: 6491 - DNA, 2319 bp, synthetic construct; identical to SEQ ID NO: 6366
  misc_feature 1..2319: note = Synthetic polypeptide
  source 1..2319: mol_type = other DNA

SEQ ID NO: 6492 - DNA, 369 bp, synthetic construct
  misc_feature 1..369: note = Synthetic polypeptide
  source 1..369: mol_type = other DNA
ggccaggcgcggcggctcatgcctgtaatcccagcactttgggaggccaagactgggtttgtagatgaaactgaagctgccaaagtggaacgtgtgaaacaggaaaaaggtattttctgggaaccctttgctaatgtgactgtagaagaagcaaagaggtcatctttacagccttatgcaaaaagagctcgtcaggagttcccctgggaagaagagtacaggtcagcgctgcatacaatagcaggggctttggaagcaactgagtcactactccaaaagggtcctgctccagcctggctttcaatggaaatggaggcgctccaagaaaggatggataagctaaaacgttacatacatactctagggtga

SEQ ID NO: 6493 - DNA, 171 bp, synthetic construct
  misc_feature 1..171: note = Synthetic polypeptide
  source 1..171: mol_type = other DNA
ggccgcacgcagtggctcgcacctataatcccagcacttcagggggccaaggcaggatttgctatgtattttggatatgggatcccacacagcttggagaacaatcaacagccaccagcgtcaagctcccaaactcctcatgaaaacatccctagtcccttgctgaattag

SEQ ID NO: 6494 - DNA, 243 bp, synthetic construct
  misc_feature 1..243: note = Synthetic polypeptide
  source 1..243: mol_type = other DNA
gccggccgcggtggctcacgcctgtaatcccagcactttgggaggccgagatgggcggatcatgaggtggaagagatcatgcagctggtgaatgcctacttggccaacccctcccccgagaggccctgcagcagctcttctcctccatgccaagacctgccagacacctcccctcccagccagcgcccgggcctggacgagccccagggacagtctggctgcttggggcagctgcaggactga

SEQ ID NO: 6495 - DNA, 2533 bp, synthetic construct
  misc_feature 1..2533: note = Synthetic polypeptide
  source 1..2533: mol_type = other DNA
tgagagacacgactagctggatttcctaggccgactaaggaatccccaagcctagctgggaaagtgaccgcttccacctttaaacatgggacttgcaacttagctcacacccgaccaatcagatagtaaggagagctcactaaaatgctaattaggcaaaaacaggaggtaaagaaatagccatctgctgcctgagagcacagcaggagggacaatgatcaggatataaacccaggcattcgagccagcaatggcaaccccctttgggtcccctccctttgtacgggagctctgttttcactgtgtttcactctattaaatcttgcaactgcactcttctggtccatgtttgttacagctcgagctgagctttcgcttgccgtccaccactgcccaccactgtcgtttgctgccatcgcagacctgctgctgacttccatccctctggatccggcaagatatgaaactatccatgaagaacaatattatcaatacacagcagtcttttgtaaccatgcccaatgtgattgtaccagatattgaaaaggaaatacgaaggatggaaaatggagcatgcagctccttttctgaggatgatgacagtgcctctacatctgaagaatcagagaatgaaaaccctcatgcaaggggttcctttagttataagtcactcagaaagggaggaccatcacagagggagcagtacctgcctggtgccattgcactttttaatgtgaacaacagcagcaataaggaccaggaaccagaagaaaaaaagaaaaagaaaaaagaaaagaagagcaagtcagatgataaaaacgaaaataaaaacgacccagagaagaaaaagaagaaaaaggacaaagagaagaaaaagaaagaggagaaaagcaaagataagaaagaagaggagaagaaagaagttgtggttattgatccctcgggaaacacatattacaactggctgttttgcatcacattacctgttatgtacaactggacaatggttattgccagagcatgttttgatgaacttcaatctgattacctagaatattggctcattttggattacgtatcagacatagtctatttaatcgatatgtttgtacgaacaaggacaggttacctagaacaaggactgctggtaaaggaagaacttaaactcataaataaatataaatccaacttgcaatttaaacttgatgttctgtcactgataccaactgatttgctgtattttaagttagggtggaactatccagaaattagattaaacaggttgttacggttctctcgtatgtttgagttcttccagagaacagaaacaaggacaaactatccaaacatcttcaggatttccaaccttgttatgtatatcgtcatcattatccactggaatgcatgtgtgttctactctatttctaaagctattggatttggaaatgatacatgggtctaccctgatattaatgatcctgaatttggccgtttggctagaaaatacgtatacagcctttactggtctacactgactttgactaccattggtgaaacaccccctcccgtgagggattctgagtatgtctttgtggtggttgatttcctaattggagtgttaatttttgctaccatcgttggtaacataggttctatgatttccaacatgaatgcagccagagcagaatttcaagcaagaattgatgctatcaagcaatatatgcattttcgaaatgtaagcaaagatatggaaaagagggttattaaatggtttgactacctgtggaccaacaaaaaaacagttgatgagaaagaagtcttaaagtatctacctgataaactaagagcagaaattgccatcaacgttcacttagacacattaaaaaaggtacgcatttttgctgattgtgaagctggtctgttggtggagttggtcttgaaattgcaaccccaagtctacagtcctggagattatatttgcaagaaaggggatatcggacgagagatgtacattatcaaggaaggcaaactcgctgtggtggcagatgatggagtcactcagtttgtggtattgagcgatggcagctacttcggtgagatcagcattcttaacattaaagggagcaaagctggcaatcgaagaacggccaatattaaaagtattggctactcagacctgttctgtctctcaaaagatgacctcatggaagctctaactgagtacccagatgccaaaactatgctggaagagaaagggaagcagattttaatgaaagatggtctactggatctaaacattgcaaatgctggcagtgatcctaaagatcttgaagagaaggttactcgaatggaggggtcagtagacctcctgcaaaccaggtttgcccgaatcttggctgagtatgagtccatgcagcagaaactgaaacaaagattaaccaaggttgagaaatttctgaaaccgcttattgacacagaattttcaagtattgagggacctggagcggaaagtgggcccatcgactctacatag

SEQ ID NO: 6496 - DNA, 543 bp, synthetic construct
  misc_feature 1..543: note = Synthetic polypeptide
  source 1..543: mol_type = other DNA
tagagtgtgagcagagtgaaatgctgcttccaggcctgacccatcaaaacctcagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctag

SEQ ID NO: 6497 - DNA, 378 bp, synthetic construct
  misc_feature 1..378: note = Synthetic polypeptide
  source 1..378: mol_type = other DNA
tagagtgtgagcagagtgaaatgctgcttccaggcctgacccatcaaaacctcagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaagctcacgtaatgcctgctggcgctgaccacacagctccttcctcctctcccagcactggcacgaagtgctccctgctgcgtcatcaccatctcgggacgcatgaccttcacgagcaataa

SEQ ID NO: 6498 - DNA, 267 bp, synthetic construct
  misc_feature 1..267: note = Synthetic polypeptide
  source 1..267: mol_type = other DNA
tagagtgtgagcagagtgaaatgctgcttccaggcctgacccatcaaaacctcagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaagctccttag

SEQ ID NO: 6499 - DNA, 416 bp, synthetic construct
  misc_feature 1..416: note = Synthetic polypeptide
  source 1..416: mol_type = other DNA
tagagtgtgagcagagtgaaatgctgcttccaggcctgacccatcaaaacctcagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaagg

SEQ ID NO: 6500 - DNA, 162 bp, synthetic construct
  misc_feature 1..162: note = Synthetic polypeptide
  source 1..162: mol_type = other DNA
tagagtgtgagcagagtgaaatgctgcttccaggcctgacccatcaaaacctcagagccgaacactgtcagctacagccagtccagcttgatccacctggtggggccttcagactgcaccctgcacggctttgtgcacggaggaggagttgactttcactga

SEQ ID NO: 6501 - DNA, 950 bp, synthetic construct
  misc_feature 1..950: note = Synthetic polypeptide
  source 1..950: mol_type = other DNA
agccaagcgtggtggtgcatgcctgtggtcccagctactcaggaggctgagccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactag

SEQ ID NO: 6502 - DNA, 269 bp, synthetic construct
  misc_feature 1..269: note = Synthetic polypeptide
  source 1..269: mol_type = other DNA
agccaagcgtggtggtgcatgcctgtggtcccagctactcaggaggctgagccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaaccgcccaggtttgctga

SEQ ID NO: 6503 - DNA, 1883 bp, synthetic construct; identical to SEQ ID NO: 6345
  misc_feature 1..1883: note = Synthetic polypeptide
  source 1..1883: mol_type = other DNA

SEQ ID NO: 6504 - DNA, 365 bp, synthetic construct
  misc_feature 1..365: note = Synthetic polypeptide
  source 1..365: mol_type = other DNA
agttgacccttgaacaacataggtgtgaactgtgagtccacttaagtggcttctctttcgcctctgccacccctgagacagcaggaccaaccctcccttcctcctcctcagcctgctctacgtgaagatgatgaggatgaagacctttatgacgatccacttccacttaatgaaaagtgaatgaaaactttgccattgatttgatagcagagcagcccgtgagcgaggtggagactcgggtgatagcgtgcgatggcggcgggggagctcttggccacccaaaagtgtatataaacttggacaaagaaacaaaaaccggcacatgcggttactgtgggctccagttcagacagcaccaccactag

SEQ ID NO: 6505 - DNA, 509 bp, synthetic construct
  misc_feature 1..509: note = Synthetic polypeptide
  source 1..509: mol_type = other DNA
agttgacccttgaacaacataggtgtgaactgtgagtccacttaagtggcttctctttcgcctctgccacccctgagacagcaggaccaaccctcccttcctcctcctcagcctgctctacgtgaagatgatgaggatgaagacctttatgacgatccacttccacttaatgaaaagtgaatgaaaactttgccattgatttgatagcagagcagcccgtgagcgaggtggagactcgggtgatagcgtgcgatggcggcgggggagctcttggccacccaaaagtgtatataaacttggtgcgtagctggccacctgtgcacatgttagggcagcctgctcgtcctcatactccccttcactcccagtgcctgttctttctgtcctcttctctacctgctcccgaggcggcccttacggggttcacactgctggcacattcaccctacagcgccacactacagggcctacatagagccgcctgtccgaaaaccccctttcaactgtga

SEQ ID NO: 6506 - DNA, 148 bp, synthetic construct; identical to SEQ ID NO: 6388
  misc_feature 1..148: note = Synthetic polypeptide
  source 1..148: mol_type = other DNA

SEQ ID NO: 6507 - DNA, 1100 bp, synthetic construct; identical to SEQ ID NO: 6389
  misc_feature 1..1100: note = Synthetic polypeptide
  source 1..1100: mol_type = other DNA

SEQ ID NO: 6508 - DNA, 464 bp, synthetic construct; identical to SEQ ID NO: 6390
  misc_feature 1..464: note = Synthetic polypeptide
  source 1..464: mol_type = other DNA

SEQ ID NO: 6509 - DNA, 280 bp, synthetic construct; identical to SEQ ID NO: 6391
  misc_feature 1..280: note = Synthetic polypeptide
  source 1..280: mol_type = other DNA

SEQ ID NO: 6510 - DNA, 459 bp, synthetic construct
  misc_feature 1..459: note = Synthetic polypeptide
  source 1..459: mol_type = other DNA
gccgggcatggtggctcacgcctgtaatcccagcactttgggaggccgaggtgggcggatcacctgaggtcgggagttcgagaccagcctgaccaacatggtgaaacctcatctccactaaaaatacaaaattagccaggcgtgatggtgcgtgcctgtaatcccagctactcgggaggctgaggcaggagaatcgcttgaacctgggaggcagagctggtgttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactga

SEQ ID NO: 6511 - DNA, 504 bp, synthetic construct
  misc_feature 1..504: note = Synthetic polypeptide
  source 1..504: mol_type = other DNA
gccgggcatggtggctcacgcctgtaatcccagcactttgggaggccgaggtgggcggatcacctgaggtcgggagttcgagaccagcctgaccaacatggtgaaacctcatctccactaaaaatacaaaattagccaggcgtgatggtgcgtgcctgtaatcccagctactcgggaggctgaggcaggagaatcgcttgaacctgggaggcagagctggtgttctctgtggacattgactcggagctggtggaggagctgccggccgaaatcgagctgtggctggtgctggtggccgtgggtgcagggctgctgctgctggggctgatcatcctcctgctgtggaagtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactga

SEQ ID NO: 6512 - DNA, 1423 bp, synthetic construct
  misc_feature 1..1423: note = Synthetic polypeptide
  source 1..1423: mol_type = other DNA
ccctgtgtgccttggtcaccccatctggcagttgacagtaacagggcctttctcacaatgctgttgggagatgaggcacagttcctggcatatcgcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacattcctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctga

SEQ ID NO: 6513 - DNA, 540 bp, synthetic construct
  misc_feature 1..540: note = Synthetic polypeptide
  source 1..540: mol_type = other DNA
caaaaaaaaatactgcattttctcacttaaaaagtaggagctaaatgatgagaacacgtggacacatggagaagaacaacacacagtggggcctttcagagggtggagagtgggaagagggagaggatcagaaaaaataactaacaggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagagtatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagaacaaaatcaacttgtttgcaaaatgaacagtgatccagagactccatga

SEQ ID NO: 6514 - DNA, 651 bp, synthetic construct
  misc_feature 1..651: note = Synthetic polypeptide
  source 1..651: mol_type = other DNA
caaaaaaaaatactgcattttctcacttaaaaagtaggagctaaatgatgagaacacgtggacacatggagaagaacaacacacagtggggcctttcagagggtggagagtgggaagagggagaggatcagaaaaaataactaacaggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagagtatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagaacaaaatcaacttgtttgcaaaatgaacagtaaagcacaacatcaggaagtgtgtttgaaagaagtacaaaatagtcttgagaagtcggaaaatcaaaatgagagtattaagaattatttacagtttcttaaaacttcttatgtaacaatgtttgaataa

SEQ ID NO: 6515 - DNA, 569 bp, synthetic construct
  misc_feature 1..569: note = Synthetic polypeptide
  source 1..569: mol_type = other DNA
caaaaaaaaatactgcattttctcacttaaaaagtaggagctaaatgatgagaacacgtggacacatggagaagaacaacacacagtggggcctttcagagggtggagagtgggaagagggagaggatcagaaaaaataactaacaggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagagtatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagaacaaaatcaacttgtttgcaaaatgaacagtaaagcacaacatcaggaagtgtgtttgaaagaagtacaaaatagtct

SEQ ID NO: 6516 - DNA, 152 bp, synthetic construct
  misc_feature 1..152: note = Synthetic polypeptide
  source 1..152: mol_type = other DNA
caaaaaaaaatactgcattttctcacttaaaaagtaggagctaaatgatgagaacacgtggacacatggagaagaacaacacacagtggggcctttcagagggtggagagtgggaagagggagaggatcagaaaaaataactaacaggttga

SEQ ID NO: 6517 - DNA, 488 bp, synthetic construct
  misc_feature 1..488: note = Synthetic polypeptide
  source 1..488: mol_type = other DNA
aagttacagaaagaaagattgtagattaccatcaggaagaactctgtaactgtcagagccatctaaagatgaaaacgtttgacctggaatgatatttgtccagtcattgtgccacaacattcaaagaagatggattatggacttacctcaatcagattgtggcctgttccccttgggttttatatatcttgatgctagcaactttccatttctcatggtcaacatttttattattaaatcaactctttcagattgcctttctgggcctgacctcccatgagagaatcagcctgcagaagcagagcaagcatatgaaacagacgttgtccctcaggaagacaccatacaatcttggattcatgcagaacctggcagatttctttcagtgtggctgctttggcttggtgaagccctgtgtggtagattggacatcacagtacaccatggtctttcacccagccagggagaaggttcttcgctcagtatga

SEQ ID NO: 6518 - DNA, 2471 bp, synthetic construct; identical to SEQ ID NO: 576
  misc_feature 1..2471: note = Synthetic polypeptide
  source 1..2471: mol_type = other DNA

SEQ ID NO: 6519 - DNA, 427 bp, synthetic construct; identical to SEQ ID NO: 573
  misc_feature 1..427: note = Synthetic polypeptide
  source 1..427: mol_type = other DNA

SEQ ID NO: 6520 - DNA, 347 bp, synthetic construct; identical to SEQ ID NO: 452
  misc_feature 1..347: note = Synthetic polypeptide
  source 1..347: mol_type = other DNA

SEQ ID NO: 6521 - DNA, 148 bp, synthetic construct; identical to SEQ ID NO: 454
  misc_feature 1..148: note = Synthetic polypeptide
  source 1..148: mol_type = other DNA

SEQ ID NO: 6522 - DNA, 370 bp, synthetic construct
  misc_feature 1..370: note = Synthetic polypeptide
  source 1..370: mol_type = other DNA
gggggaggagccaagatggccgaataggaacagctccggtctacagctcccagcgtgagcagaagacggcgatttctgcatttccatctgaggtaattggtatgtgaaaaagtgtctaaacgacgttggaatttgcaagaagaagtgcaaacctgaagagatgcatgtaaagaatggttgggcaatgtgcggcaaacaaagggactgctgtgttccagctgacagacgtgctaattatcctgttttctgtgtccagacaaagactacaagaatttcaacagtaacagcaacaacagcaacaacaactttgatgatgactactgcttcgatgtcttcgatggctcctacccccgtttctcccactggttga

SEQ ID NO: 6523 - DNA, 829 bp, synthetic construct; identical to SEQ ID NO: 624
  misc_feature 1..829: note = Synthetic polypeptide
  source 1..829: mol_type = other DNA

SEQ ID NO: 6524 - DNA, 1331 bp, synthetic construct; identical to SEQ ID NO: 550
  misc_feature 1..1331: note = Synthetic polypeptide
  source 1..1331: mol_type = other DNA

SEQ ID NO: 6525 - DNA, 1028 bp, synthetic construct; identical to SEQ ID NO: 551
  misc_feature 1..1028: note = Synthetic polypeptide
  source 1..1028: mol_type = other DNA

SEQ ID NO: 6526 - DNA, 1295 bp, synthetic construct; identical to SEQ ID NO: 553
  misc_feature 1..1295: note = Synthetic polypeptide
  source 1..1295: mol_type = other DNA

SEQ ID NO: 6527 - DNA, 1322 bp, synthetic construct; identical to SEQ ID NO: 554
  misc_feature 1..1322: note = Synthetic polypeptide
  source 1..1322: mol_type = other DNA

SEQ ID NO: 6528 - DNA, 1013 bp, synthetic construct; identical to SEQ ID NO: 555
  misc_feature 1..1013: note = Synthetic polypeptide
  source 1..1013: mol_type = other DNA

SEQ ID NO: 6529 - DNA, 229 bp, synthetic construct
  misc_feature 1..229: note = Synthetic polypeptide
  source 1..229: mol_type = other DNA
gccaggtccccctgttgcctgttctcctctggtcagcatctctgcacatgtttacctgatgatgcagatgaccactgagacctgggcccaatgtggagtctggatgttgattggatttgctatgtattttggatatgggatcccacacagcttggagaacaatcaacagccaccagcgtcaagctcccaaactcctcatgaaaacatccctagtcccttgctgaattag

SEQ ID NO: 6530 - DNA, 529 bp, synthetic construct
  misc_feature 1..529: note = Synthetic polypeptide
  source 1..529: mol_type = other DNA
tttcttggttccctgaccggcaagcgaggctcaacagtaccagcagcagcgtcgaaaatttgcagctgccttcttggcattcattttcatactggcagctgtggatactgctgaagcagggaagaaagagaaaccagaaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatcccctgcaactggaagaagcaatttggcgcggagtgcaaataccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaacctcaagcagaatctaagaagaagaaaaaggaaggcaagaaacaggagaagatgctggattaa

SEQ ID NO: 6531 - DNA, 523 bp, synthetic construct
  misc_feature 1..523: note = Synthetic polypeptide
  source 1..523: mol_type = other DNA
tttcttggttccctgaccggcaagcgaggctcaacagtaccagcagcagcgtcgaaaatttgcagctgccttcttggcattcattttcatactggcagctgtggatactgctgaagcagggaagaaagagaaaccagaaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatcccctgcaactggaagaagcaatttggcgcggagtgcaaataccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaacctcaagagaagggaaaatggagacacaggagtggggagagtttgagaagatggtag

SEQ ID NO: 6532 - DNA, 1077 bp, synthetic construct
  misc_feature 1..1077: note = Synthetic polypeptide
  source 1..1077: mol_type = other DNA
aggcaggagaatagtagagggaagtgaaggggcaggtgaacacaaagcaagagaagaagcagaagttgagcagccaaaacaaaagggagataagcaagtaagagaccccatggccggcaagatccagaccagaccagtaaaggctcatttgtgagaactaaaatagatactacggagaacttgctcaacacagaggtgcacagctcgccagcgcagcgctggtccatgcaggtgccacccgaggtgagcgcggaggcaggcgacgcggcagtgctgccctgcaccttcacgcacccgcaccgccactacgacgggccgctgacggccatctggcgcgcgggcgagccctatgcgggcccgcaggtgttccgctgcgctgcggcgcggggcagcgagctctgccagacggcgctgagcctgcacggccgcttccggctgctgggcaacccgcgccgcaacgacctctcgctgcgcgtcgagcgcctcgccctggctgacgaccgccgctacttctgccgcgtcgagttcgccggcgacgtccatgaccgctacgagagccgccacggcgtccggctgcacgtgacagccgcgccgcggatcgtcaacatctcggtgctgcccagtccggctcacgccttccgcgcgctctgcactgccgaaggggagccgccgcccgccctcgcctggtccggcccggccctgggcaacagcttggcagccgtgcggagcccgcgtgagggtcacggccacctagtgaccgccgaactgcccgcactgacccatgacggccgctacacgtgtacggccgccaacagcctgggccgctccgaggccagcgtctacctgttccgcttccatggcgccagcggggcctcgacggtcgccctcctgctcggcgctctcggcttcaaggcgctgctgctgctcggggtcctggccgcccgcgctgcccgccgccgcccagagcatctggacaccccggacaccccaccacggtcccaggcccaggagtccaattatgaaaatttgagccagatgaacccccggagcccaccagccaccatgtgctcaccgtga

SEQ ID NO: 6533 - DNA, 463 bp, synthetic construct; identical to SEQ ID NO: 524
  misc_feature 1..463: note = Synthetic polypeptide
  source 1..463: mol_type = other DNA

SEQ ID NO: 6534 - DNA, 842 bp, synthetic construct
  misc_feature 1..842: note = Synthetic polypeptide
  source 1..842: mol_type = other DNA
caaacaactgataaacacagcaacatggatgaacttcaaaaacactaagcaaaagaagccagacacaaaagtacatagattctgcggacttggagcccatcacctcgcaagaagagcccgtgcgctaccacgaagcttggcagaagctctgtagtgctcatggagtgctggttccaggaggatttggtgttcgaggaacagaaggaaaaatccaagcaattgcctgggctcggaatcagaaaaagccttttttgggcgtgtgcttagggatgcagttggcagtggttgaattctcaagaaacgtgctgggatggcaagatgccaattctacagagtttgaccctacgaccagtcatcccgtggtcgtagacatgccagaacacaacccagggcagatgggcggaaccatgaggctgggcaagaggagaaccctgttccagaccaagaactcagtcatgaggaaactctatggagacgcagactacttggaagagaggcaccgccaccgatttgaggtgaatccagtctggaaaaagtgtttggaagaacaaggcttgaagtttgttggccaagatgttgaaggagagagaatggaaattgtggagttagaagatcatcccttttttgttggggttcagtaccaccctgagttcctgtccaggcctatcaagccctccccaccatactttggcctcctcctggcctctgtggggcggctctcacattacctccagaaaggctgcaggctctcacccagggacacctatagtgacaggagtggaagcagctcccctgactctgaaatcaccgaactgaagtttccatcaataaatcatgactga

SEQ ID NO: 6535 - DNA, 844 bp, synthetic construct
  misc_feature 1..844: note = Synthetic polypeptide
  source 1..844: mol_type = other DNA
aatctcaatttctacatctataaaagtaaggactatatcctaactttgcaggatggttgtgtggaattaaatgaaaaaatctacagaaaacatcttgggaacacctggcacatagttatttacctttagtgaattccatcttctgaaaacaatgcttttgtgggtcttcttgcaactgaactacaagattcaggcaattccgacttatgaaaccgtgatgacattttttaagagctttcctgagaactgttgctttctggaccgggacataggacggagcttgaggccgctcttcctctgcttgcgtctgcacggcatcaccaaaggcaaggatctggaggtgctgcggcaccttaacttcttcccagagtcatggctcgaccaggttacagtcaaccattaccacgcactggagaatgggggcgacatggtccacctgaaagatcttaacacccaggctgtgagatttgggctgctctttaaccaggagaatacaacttattcgaaaacgattgctctatatggattcttctttaagataaagggactcaaacatgatactacctcttatagtttttacatgcagagaataaagcacacagacctggaatctccctctgcggtctacgagcacaaccacgtcagcctgcgagcggcacgcctggtgaagtatgagatcagagcagaggccctggttgacggcaagtggcaggagttcaggacaaaccagatcaagcagaagtttgggttgaccacgtcatcctgcaaaagccataccttgaaaatccaaactgtgggcatcccaatctatgtaagttttgcattcatcttcccagcatcttga

SEQ ID NO: 6536 - DNA, 309 bp, synthetic construct
  misc_feature 1..309: note = Synthetic polypeptide
  source 1..309: mol_type = other DNA
ccctggagccaggcgagcccacgtttgagtttcaaatctcccacctcctggctgtgtgtcctcagccaagaggctctgaagtcactgcaggagcggcggcgggagcaggagctgctggagcagtacgtgagcaccgtgaacgaccgcagtgacatcgtggactcgctggacgaggaccggctccgggaacaagaggaggatcagatgctgcgggacatgattgagaagctgggcctccagaggaagaagtccaagttccgcttgtccaagatctggtcaccaaaaagcaaaagcagcccctcccagtag

SEQ ID NO: 6537 - DNA, 1647 bp, synthetic construct
  misc_feature 1..1647: note = Synthetic polypeptide
  source 1..1647: mol_type = other DNA
caaaatatccttcttgggccaaaaacattgacatcattggggccattgcaatttagagacgtggccatagaattctctctggaggagtggcattgcctggacactgcacagcggaatttatataggaatgtgatgttagagaactacagaaacctggtcttccttggtattgttgtctctaagccagacctcatcacctgtctggagcaaggaaaaaaacctttgaccatgaagaaacatgagatggtagccaacccctcagttacgtgttctcattttgcccgagatctttggccagagcagagcataaaagattctttccaaaaagtgacactgagaagatatgaaaactatggacatgacaatttacagtttaaaaagggctgtgaaagtgtagatgagtgtaaggtgcacaaaagaggttataatggacttaaccaatatttgacaactactcaaagcaaaatatttcagtgtgataaatatgtgaaagtcattcataaattttcaaattcaaacagacataagataagacatactggaaaaaaacctttcaaatgtatagaatgtggcaaagcttttaaccagtcttcaacccttactacacataagaaaattcatactggggagaaacccttcaaatgtgaagaatgtggcaaagccttcaactggtcctcacaccttactacacataagagaattcatactggagagaaacggtacaaatgtgaagactgtggcaaagcctttagccggttttcataccttactgcacataagataattcatagtggagagaaaccctacaaatgtgaagaatgtggcaaggcctttaagcgctcctctaaccttactacacataagataattcatactggagagaaaccctacaaatgtgaagaatgtggcaaggcctttaagcgctcctctatccttactgcgcataagataattcatagcggagagaaaccctacaaatgtgaagaatgtggcaaagcctttaagcacccctctgtccttactacacataaaagaattcatactggagagaaaccctacaaatgtgaagaatgtggcagagcctttaagtacttctcatcccttactacacacaagataattcatagtggagagaaaccctacaaatgtgaagaatgtggcaaagccttcaactggtcctcacaccttactacacataagagaattcatactggagagaaaccctacaaatgtgaagaatgtggcgaagcctttaagtactcctcttcccttactacacataagataatccatactggacagcaacccttcaagtgtgaagaatgtggcaaggcctttaagtgcttctctatccttactacacataagagaattcatactggagagaaaccctacaaatgtgaagaatgtggcaaagccttcaactcgtcctcacaccttactgcacataagagaattcatactggagagaaaccctacaaatgtgaacgatgtggcaaggcttttaagcgctcctttatccttactagacataagagaattcatactggagagaaaccctacaaatgtgaagaatgtggcaaaggctttaagtgcccctctacccttactacacataaggtaattcatactggagagaaactataa

SEQ ID NO: 6538 - DNA, 70 bp, synthetic construct
  misc_feature 1..70: note = Synthetic polypeptide
  source 1..70: mol_type = other DNA
caaaatatccttcttgggccaaaaacattgacatcattggggccattgcaatttagagacgtggccatag

SEQ ID NO: 6539 - DNA, 432 bp, synthetic construct
  misc_feature 1..432: note = Synthetic polypeptide
  source 1..432: mol_type = other DNA
caaaatatccttcttgggccaaaaacattgacatcattggggccattgcaatttagagacgtggccatagaattctctctggaggagtggcattgcctggacactgcacagcggaatttatataggaatgtgatgttagagaactacagaaacctggtcttccttggtattgttgtctctaagccagacctcatcacctgtctggagcaaggaaaaaaacctttgaccatgaagaaacatgagatggtagccaacccctcagagactgggtttcaccatgttggcaagggtggtctcaaactcctgacctcagatgatctgcctgcctcggcctcccaaagtactggaattacaggcatgaggcaccccgcccggcccaattgtgtgggcttctatgtaggcagaactgaccataaactgtggctcaggtaa

SEQ ID NO: 6540 - DNA, 943 bp, synthetic construct
  misc_feature 1..943: note = Synthetic polypeptide
  source 1..943: mol_type = other DNA
tgcaggagacacctgaagcttctgccacccaatatcaattcacctttcttctaaaatattacggtgttatgtatgattcccctttggggaccaccccctttcctgttctcagcccagtctcagtctcttcctggttgagttgactccatctccggctgcagggatgggcatgtgactcaagcttggccaatcagagcacagcagtcccccggaccacactaattggcttagaaacgggcctgtgagtcaatcagagaaaatgagaagccatgaggcctttgggagaatcttaggaaaaaattctctctcatccccttgggattcaaagctgagaagatgtaaggactggagctgcagcagtctttctgggaccattatacagagattctgtctgaggttggatccacgtggtcaaaagtattgctgaggagccagagagagactgaggtctgatgacatcacttgagccctgcagacttttcatttacgggaaaacagagaggatgaaggcctatctaaagagcgcagaaggcttttttgtcctaaataaaagtaccacaattggaaggcatgaaaattcagaccttgttttacaggtctctttcccatggatgaggggcccagcaccatggccagggccacagccacctcgtgccacacagcagccaaaccaggcccccccaccatcacatatccccttccaccaaggtgtccagccagcaccgatgcaaaggagctggtcccaggcctttcccagacccaccgtggtcctgccggcctcccacaggcggcctgtgagcgccaacaaggagatgttctcgttcgtggtggacgacgcccgcaagccacccgtcatcaagcaagtgtggaccaatgccatgaaactgtcagaaaaatcagtggccgaggggattcctggggcagttccccctgcggagattta

SEQ ID NO: 6541 - DNA, 2812 bp, synthetic construct
  misc_feature 1..2812: note = Synthetic polypeptide
  source 1..2812: mol_type = other DNA
tttcttggttccctgaccgggaagcaaggtgattaacagatggtcgaggcagctccttaggcggctttagcctgccctgtggaacatccctgctggggactccaaccagccagagtgacgcggatcctgagagctctcctgggtaggcatttgccccggtgggacacctcgccagagcagtgtgtggcaggcccccgtggaggatcaacagagtggctgaacaccgggaaggaattggcacttggagtccggacaactaaaacttggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgattctccttcttctgtggttaacaaacagctcggatccatgtcacttgacgagcaacaggataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataa

SEQ ID NO: 6542 - DNA, 1588 bp, synthetic construct
  misc_feature 1..1588: note = Synthetic polypeptide
  source 1..1588: mol_type = other DNA
tttcttggttccctgaccgggaagcaaggtgattaacagatggtcgaggcagctccttaggcggctttagcctgccctgtggaacatccctgctggggactccaaccagccagagtgacgcggatcctgagagctctcctgggtaggcatttgccccggtgggacacctcgccagagcagtgtgtggcaggcccccgtggaggatcaacagagtggctgaacaccgggaaggaattggcacttggagtccggacaactaaaacttggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctggtcccctgaagtcatgggttgctggctcctgctcagagtga

SEQ ID NO: 6543 - DNA, 2932 bp, synthetic construct
  misc_feature 1..2932: note = Synthetic polypeptide
  source 1..2932: mol_type = other DNA
tttcttggttccctgaccgggaagcaaggtgattaacagatggtcgaggcagctccttaggcggctttagcctgccctgtggaacatccctgctggggactccaaccagccagagtgacgcggatcctgagagctctcctgggtaggcatttgccccggtgggacacctcgccagagcagtgtgtggcaggcccccgtggaggatcaacagagtggctgaacaccgggaaggaattggcacttggagtccggacaactaaaacttggaagaagagaatttatccaaagattaaaacttgaagcaacccttaatgtgcatgatggttgtgttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgaatttttaaggggccctgagatagctttgcttcgtaagcgcctgcaacaactgaggcttaagaaggctgagcagcagaggcagcaagagctagctgcacatacccagcaacagccttccacttctgatcagtcttctcatgagggctcttcacaggaccctcatgcttcagattctccttcttctgtggttaacaaacagctcggatccatgtcacttgacgagcaacaggataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagatttaatatcagaggaacaacaataggtgatagaataatgagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataa

SEQ ID NO: 6544 - DNA, 2752 bp, synthetic construct
  misc_feature 1..2752: note = Synthetic polypeptide
  source 1..2752: mol_type = other DNA
tttcttggttccctgaccgggaagcaaggtgattaacagatggtcgaggcagctccttaggcggctttagcctgccctgtggaacatccctgctggggactccaaccagccagagtgacgcggatcctgagagctctcctgggtaggcatttgccccggtgggacacctcgccagagcagtgtgtggcaggcccccgtggaggatcaacagagtggctgaacaccgggaaggaattggcacttggagtccggacaactaaaacttggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataa

SEQ ID NO: 6545 - DNA, 3025 bp, synthetic construct
  misc_feature 1..3025: note = Synthetic polypeptide
  source 1..3025: mol_type = other DNA
tttcttggttccctgaccgggaagcaaggtgattaacagatggtcgaggcagctccttaggcggctttagcctgccctgtggaacatccctgctggggactccaaccagccagagtgacgcggatcctgagagctctcctgggtaggcatttgccccggtgggacacctcgccagagcagtgtgtggcaggcccccgtggaggatcaacagagtggctgaacaccgggaaggaattggcacttggagtccggacaactaaaacttggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgaatttttaaggggccctgagatagctttgcttcgtaagcgcctgcaacaactgaggcttaagaaggctgagcagcagaggcagcaagagctagctgcacatacccagcaacagccttccacttctgatcagtcttctcatgagggctcttcacaggaccctcatgcttcagattctccttcttctgtggttaacaaacagctcggatccatgtcacttgacgagcaacaggataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagatttaatatcagaggaacaacaataggtgatagaataatgagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataa

SEQ ID NO: 6546 - DNA, 275 bp, synthetic construct
  misc_feature 1..275: note = Synthetic polypeptide
  source 1..275: mol_type = other DNA
gccggccgcggtggctcacgcctgtaatcccagcactttgggaggccgagatgggcggatcatgaggtcaggagatcgagaccatcttggctaacacggtggaagagatcatgcagctggtgaatgcctacttggccaacccctcccccgagaggccctgcagcagctcttctcctccatgccaagacctgccagacacctcccctcccagccagcgcccgggcctggacgagccccagggacagtctggctgcttggggcagctgcaggactga

SEQ ID NO: 6547 - DNA, 1209 bp, synthetic construct
  misc_feature 1..1209: note = Synthetic polypeptide
  source 1..1209: mol_type = other DNA
ggctgggcatggtggctcacacctgtaatctcagcactttgggaagctgaggcaggaggatcacttgaggccaggagttcaagaccagcctgagcaacatagagagatcctgtctctaaacaaaattttaaaaattagccagtaaccatggacccaaacgtgttgagaagtgatgtcttcgttgagtttttaaaactggcgcagctgaatacatttgacatcgccaccaagaaagcttatctggacatatttctgcccaatgaacagagtattagaatcgaaattataacatcagacactgctgaaagagtcctagaggtggtgtcacacaaaattggactgtgtcgagagctcttgggctacttcggcctctttctcattcggtttggcaaggagggcaagctctctgttgtgaaaaaattggctgactttgaactcccttatgttagtcttggaagttctgaggtggaaaactgtaaggttggactccgaaagtggtatatggctccatccctcgactccgtgctgatggactgcagggtggcggtagatttgctctacatgcaggcaatacaggacattgaaaaaggatgggccaaacccacacaggcacagaggcagaaattagaagctttccagaaagaagacagtcaaacaaagtttttggagctggcccgggaggtacggcactatggatacctgcagctggatccttgtacctgtgactacccagaatcaggctctggagctgttctttctgttggcaataatgagatcagctgctgcatcaccctgcctgacagccagacccaggacatcgttttccagatgagcagggtgaagtgctggcaggtcactttccttggaactctgctggatacggatgggccccagagaactctcaaccagaacttagagctcagatttcaatacagtgaggatagttgctggcagtggtttgttatttacaccaaacaggcttttttgctgagtagctgcttgaaaaagatgatctcagaaaagatggtaaagctagctgctgagaatacagaaatgcagattgaagttccggaacaaagcaaaagtaaaaaataccacattcaacaaagccagcagaaagactattctagttttctatcaagaaaaagcaagattaagatagctaaagatgactgcgtttttgggaacataaaggaagaagatctctga

SEQ ID NO: 6548 - DNA, 458 bp, synthetic construct
  misc_feature 1..458: note = Synthetic polypeptide
  source 1..458: mol_type = other DNA
ggctgggcatggtggctcacacctgtaatctcagcactttgggaagctgaggcaggaggatcacttgaggccaggagttcaagaccagcctgagcaacatagagagatcctgtctctaaacaaaattttaaaaattagccagtaaccatggacccaaacgtgttgagaagtgatgtcttcgttgagtttttaaaactggcgcagctgaatacatttgacatcgccaccaagaaagcttatctggacatatttctgcccaatgaacagagtattagaatcgaaattataacatcagacactgctgaaagagtcctagaggtggtgtcacacaaaattggactgtgtcgagagctcttgggctacttcggcctctttctcattcggtttggcaaggagggcaagctctctgttgtgaaaaaattggctgactttgaactcccttatgttagtcttggaag

SEQ ID NO: 6549 - DNA, 294 bp, synthetic construct
  misc_feature 1..294: note = Synthetic polypeptide
  source 1..294: mol_type = other DNA
ggctgggcatggtggctcacacctgtaatctcagcactttgggaagctgaggcaggaggatcacttgaggccaggagttcaagaccagcctgagcaacatagagagatcctgtctctaaacaaaattttaaaaattagccagtaaccatggacccaaacgtgttgagaagtgatgtcttcgttgagtttttaaaactggcgcagctgaatacatttgacatcgccaccaagaaagcttatctggacatatttctgcccaatgaacagagtattagaatcgaaattataacatca

SEQ ID NO: 6550 - DNA, 423 bp, synthetic construct
  misc_feature 1..423: note = Synthetic polypeptide
  source 1..423: mol_type = other DNA
ggagttagaaggcatcgcctctaatccaggtttcgccatctcctctgctaagtgacgtccagcaagtcacttcactttcaggacctcaaatctcctccccagtagtaaaataggggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatag

SEQ ID NO: 6551 - DNA, 133 bp, synthetic construct
  misc_feature 1..133: note = Synthetic polypeptide
  source 1..133: mol_type = other DNA
taagttaaacatggaaagcgcttagaatggttctggcatgcaaccagttgcacgtgcattatttaatcacatagacaagtcaggattgaaggatagttctgtcgaagaactcaagaaaagatacggtggttga

SEQ ID NO: 6552 - DNA, 386 bp, synthetic construct
  misc_feature 1..386: note = Synthetic polypeptide
  source 1..386: mol_type = other DNA
gccctctccttccttttccttctatatacatgctctcttgcccttctgccttcaaccgtgggatgacacaacatgaaggacctcaccagatgtaagcccctcaaccttggacttctcagcctccagaactttccatggaaaatgggagaccacctgatcctgcagactgggccgtgatggatgtcgtcaattatttccgaaccgtgggatttgaggagcaagctagtgcttttcaggaacaggaaattgatggaaaatccctgctattgatgacaagaaatgatgtgttgacaggacttcagttaaaattggggcctgctctgaaaatctacgaatatcatgtaaaacctctgcagacaaagcatttaaagaacaactcttcatag

SEQ ID NO: 6553 - DNA, 1022 bp, synthetic construct; identical to SEQ ID NO: 590
  misc_feature 1..1022: note = Synthetic polypeptide
  source 1..1022: mol_type = other DNA

SEQ ID NO: 6554 - DNA, 347 bp, synthetic construct; identical to SEQ ID NO: 591
  misc_feature 1..347: note = Synthetic polypeptide
  source 1..347: mol_type = other DNA

SEQ ID NO: 6555 - DNA, 1109 bp, synthetic construct; identical to SEQ ID NO: 592
  misc_feature 1..1109: note = Synthetic polypeptide
  source 1..1109: mol_type = other DNA

SEQ ID NO: 6556 - DNA, 85 bp, synthetic construct; identical to SEQ ID NO: 601
  misc_feature 1..85: note = Synthetic polypeptide
  source 1..85: mol_type = other DNA

SEQ ID NO: 6557 - DNA, 269 bp, synthetic construct; identical to SEQ ID NO: 600
  misc_feature 1..269: note = Synthetic polypeptide
  source 1..269: mol_type = other DNA

SEQ ID NO: 6558 - DNA, 3055 bp, synthetic construct; identical to SEQ ID NO: 709
  misc_feature 1..3055: note = Synthetic polypeptide
  source 1..3055: mol_type = other DNA

SEQ ID NO: 6559 - DNA, 3058 bp, synthetic construct; identical to SEQ ID NO: 710
  misc_feature 1..3058: note = Synthetic polypeptide
  source 1..3058: mol_type = other DNA

SEQ ID NO: 6560 - DNA, 1221 bp, synthetic construct
  misc_feature 1..1221: note = Synthetic polypeptide
  source 1..1221: mol_type = other DNA
tgagaggtgacaatatgctagcagcccttgctcactcttggtgcctcctcgtcctccacatccactctggctgcacttgaggagcccttcagcccaccactgcactgtgggggcccctctctggggctggccaaggccgaagccagctccctctgctcgccaggaggtgtggagggagaggcgccggcaggagcccacactgtacagggcactcaccggccagcaggggctccgtgggccggccggtgccagctgggcctgactgggggatgagctccctctgggctgctggagtgcctgggctaggtgccgcaaagtcctgcagtgtgtgccattgagaggtgaagccggctgggcttctgggtccggtggggacctggagaacttttctgtctagctaaaggtttgtaaatgcacccatcagcactctgtgtctagctaaaggtttgtaaatgcaccaatcagcaatctgtgtctagccaatctggtggggacttggagaacttttgtgtctagctaaaggattgtaaatgcaccaatcagcactctgtgtctagctaaaggtttgtaaatgcaccaatcagcactctgtcaaaacggaccaatcagctctctgtaaaacagaccaatcagctctctgtaaaatggaccaatcagctctccataaaatggaccaatcagcaggatgtgggtgtggccagttaagggaataaaagcaggctgcctgagccggcagcagcaacctgctctggttcccttccacgctgtggaagctttgttcttttggtcttcatgataaatcttgctgctgctcactcgttgggtccgtgccacctttaagagctgtaacactcaccgcgaaggtctgcaacttcactcctggggccagcaagaccacgaatgcaccgagaggaatgaacaactctggacacaccatctttaagaaccgtaatactcaccgcaaggatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtg

SEQ ID NO: 6561 - DNA, 1389 bp, synthetic construct
  misc_feature 1..1389: note = Synthetic polypeptide
  source 1..1389: mol_type = other DNA
tgagaggtgacaatatgctagcagcccttgctcactcttggtgcctcctcgtcctccacatccactctggctgcacttgaggagcccttcagcccaccactgcactgtgggggcccctctctggggctggccaaggccgaagccagctccctctgctcgccaggaggtgtggagggagaggcgccggcaggagcccacactgtacagggcactcaccggccagcaggggctccgtgggccggccggtgccagctgggcctgactgggggatgagctccctctgggctgctggagtgcctgggctaggtgccgcaaagtcctgcagtgtgtgccattgagaggtgaagccggctgggcttctgggtccggtggggacctggagaacttttctgtctagctaaaggtttgtaaatgcacccatcagcactctgtgtctagctaaaggtttgtaaatgcaccaatcagcaatctgtgtctagccaatctggtggggacttggagaacttttgtgtctagctaaaggattgtaaatgcaccaatcagcactctgtgtctagctaaaggtttgtaaatgcaccaatcagcactctgtcaaaacggaccaatcagctctctgtaaaacagaccaatcagctctctgtaaaatggaccaatcagctctccataaaatggaccaatcagcaggatgtgggtgtggccagttaagggaataaaagcaggctgcctgagccggcagcagcaacctgctctggttcccttccacgctgtggaagctttgttcttttggtcttcatgataaatcttgctgctgctcactcgttgggtccgtgccacctttaagagctgtaacactcaccgcgaaggtctgcaacttcactcctggggccagcaagaccacgaatgcaccgagaggaatgaacaactctggacacaccatctttaagaaccgtaatactcaccgcaaggatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6562 - DNA, 1449 bp, synthetic construct
  misc_feature 1..1449: note = Synthetic polypeptide
  source 1..1449: mol_type = other DNA
tgagaggtgacaatatgctagcagcccttgctcactcttggtgcctcctcgtcctccacatccactctggctgcacttgaggagcccttcagcccaccactgcactgtgggggcccctctctggggctggccaaggccgaagccagctccctctgctcgccaggaggtgtggagggagaggcgccggcaggagcccacactgtacagggcactcaccggccagcaggggctccgtgggccggccggtgccagctgggcctgactgggggatgagctccctctgggctgctggagtgcctgggctaggtgccgcaaagtcctgcagtgtgtgccattgagaggtgaagccggctgggcttctgggtccggtggggacctggagaacttttctgtctagctaaaggtttgtaaatgcacccatcagcactctgtgtctagctaaaggtttgtaaatgcaccaatcagcaatctgtgtctagccaatctggtggggacttggagaacttttgtgtctagctaaaggattgtaaatgcaccaatcagcactctgtgtctagctaaaggtttgtaaatgcaccaatcagcactctgtcaaaacggaccaatcagctctctgtaaaacagaccaatcagctctctgtaaaatggaccaatcagctctccataaaatggaccaatcagcaggatgtgggtgtggccagttaagggaataaaagcaggctgcctgagccggcagcagcaacctgctctggttcccttccacgctgtggaagctttgttcttttggtcttcatgataaatcttgctgctgctcactcgttgggtccgtgccacctttaagagctgtaacactcaccgcgaaggtctgcaacttcactcctggggccagcaagaccacgaatgcaccgagaggaatgaacaactctggacacaccatctttaagaaccgtaatactcaccgcaaggatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtggtgaggattggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctga

SEQ ID NO: 6563 - DNA, 1341 bp, synthetic construct
  misc_feature 1..1341: note = Synthetic polypeptide
  source 1..1341: mol_type = other DNA
tgagaggtgacaatatgctagcagcccttgctcactcttggtgcctcctcgtcctccacatccactctggctgcacttgaggagcccttcagcccaccactgcactgtgggggcccctctctggggctggccaaggccgaagccagctccctctgctcgccaggaggtgtggagggagaggcgccggcaggagcccacactgtacagggcactcaccggccagcaggggctccgtgggccggccggtgccagctgggcctgactgggggatgagctccctctgggctgctggagtgcctgggctaggtgccgcaaagtcctgcagtgtgtgccattgagaggtgaagccggctgggcttctgggtccggtggggacctggagaacttttctgtctagctaaaggtttgtaaatgcacccatcagcactctgtgtctagctaaaggtttgtaaatgcaccaatcagcaatctgtgtctagccaatctggtggggacttggagaacttttgtgtctagctaaaggattgtaaatgcaccaatcagcactctgtgtctagctaaaggtttgtaaatgcaccaatcagcactctgtcaaaacggaccaatcagctctctgtaaaacagaccaatcagctctctgtaaaatggaccaatcagctctccataaaatggaccaatcagcaggatgtgggtgtggccagttaagggaataaaagcaggctgcctgagccggcagcagcaacctgctctggttcccttccacgctgtggaagctttgttcttttggtcttcatgataaatcttgctgctgctcactcgttgggtccgtgccacctttaagagctgtaacactcaccgcgaaggtctgcaacttcactcctggggccagcaagaccacgaatgcaccgagaggaatgaacaactctggacacaccatctttaagaaccgtaatactcaccgcaaggatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6564 - DNA, 1332 bp, synthetic construct
  misc_feature 1..1332: note = Synthetic polypeptide
  source 1..1332: mol_type = other DNA
tgagaggtgacaatatgctagcagcccttgctcactcttggtgcctcctcgtcctccacatccactctggctgcacttgaggagcccttcagcccaccactgcactgtgggggcccctctctggggctggccaaggccgaagccagctccctctgctcgccaggaggtgtggagggagaggcgccggcaggagcccacactgtacagggcactcaccggccagcaggggctccgtgggccggccggtgccagctgggcctgactgggggatgagctccctctgggctgctggagtgcctgggctaggtgccgcaaagtcctgcagtgtgtgccattgagaggtgaagccggctgggcttctgggtccggtggggacctggagaacttttctgtctagctaaaggtttgtaaatgcacccatcagcactctgtgtctagctaaaggtttgtaaatgcaccaatcagcaatctgtgtctagccaatctggtggggacttggagaacttttgtgtctagctaaaggattgtaaatgcaccaatcagcactctgtgtctagctaaaggtttgtaaatgcaccaatcagcactctgtcaaaacggaccaatcagctctctgtaaaacagaccaatcagctctctgtaaaatggaccaatcagctctccataaaatggaccaatcagcaggatgtgggtgtggccagttaagggaataaaagcaggctgcctgagccggcagcagcaacctgctctggttcccttccacgctgtggaagctttgttcttttggtcttcatgataaatcttgctgctgctcactcgttgggtccgtgccacctttaagagctgtaacactcaccgcgaaggtctgcaacttcactcctggggccagcaagaccacgaatgcaccgagaggaatgaacaactctggacacaccatctttaagaaccgtaatactcaccgcaaggatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggcaagtggggtttggagatttggtggtccatgtgtggctaggcaggggcagttga

SEQ ID NO: 6565 - DNA, 541 bp, synthetic construct; identical to SEQ ID NO: 787
  misc_feature 1..541: note = Synthetic polypeptide
  source 1..541: mol_type = other DNA

SEQ ID NO: 6566 - DNA, 1232 bp, synthetic construct
  misc_feature 1..1232: note = Synthetic polypeptide
  source 1..1232: mol_type = other DNA
tgataggtttggctgtgtccccaccgaaatctcaacttgaattgtatctcccagaattcccacgtattgtgggagggacctaagaggaggtagttgaatcatgagggccagtttttctcgtgctagtctcgtgatagtaagtctcacgagatctgatgggtttatcaggggtctccgcttttgcttctttctcattttctcttgctgtcgctgcttaagaagagcctttcgcctcccaccatgattgtgagaactcctcagccatgtggaactagctggtgatgctgctggagtggtggtcgggcacggaatgcaccatcttcacggacccgcgcgcctacctcaagtatgggaaggaaaatgccatcgtggttctcaaccacaagtttgaaattgactttctgtgtggctggagcctgtccgaacgctttgggctgttagggggctccaaggtcctggccaagaaagagctggcctatgtcccaattatcggctggatgtggtacttcaccgagatggtcttctgttcgcgcaagtgggagcaggatcgcaagacggttgccaccagtttgcagcacctccgggactaccccgagaagtattttttcctgattcactgtgagggcacacggttcacggagaagaagcatgagatcagcatgcaggtggcccgggccaaggggctgcctcgcctcaagcatcacctgttgccacgaaccaagggcttcgccatcaccgtgaggagcttgagaaatgtagtttcagctgtatatgactgtacactcaatttcagaaataatgaaaatccaacactgctgggagtcctaaacggaaagaaataccatgcagatttgtatgttaggaggatcccactggaagacatccctgaagacgatgacgagtgctcggcctggctgcacaagctctaccaggagaaggatgcctttcaggaggagtactacaggacgggcaccttcccagagacgcccatggtgcccccccggcggccctggaccctcgtgaactggctgttttgggcctcgctggtgctctaccctttcttccagttcctggtcagcatgatcaggagcgggtcttccctgacgctggccagcttcatcctcgtcttctttgtggcctccgtgggagttcgatggatgattggtgtgacggaaattgacaagggctctgcctacggcaactctgacagcaagcagaaactgaatgactga

SEQ ID NO: 6567 - DNA, 497 bp, synthetic construct
  misc_feature 1..497: note = Synthetic polypeptide
  source 1..497: mol_type = other DNA
tgataggtttggctgtgtccccaccgaaatctcaacttgaattgtatctcccagaattcccacgtattgtgggagggacctaagaggaggtagttgaatcatgagggccagtttttctcgtgctagtctcgtgatagtaagtctcacgagatctgatgggtttatcaggggtctccgcttttgcttctttctcattttctcttgctgtcgctgcttaagaagagcctttcgcctcccaccatgattgtgagaactcctcagccatgtggaactagctggtgatgctgctggagtggtggtcgggcacggaatgcaccatcttcacggacccgcgcgcctacctcaagtatgggaaggaaaatgccatcgtggttctcaaccacaagtttgaaattgactttctgtgtggctggagcctgtccgaacgctttgggctgttagggtttgacctcttgcacgtagcttgcatgcctttggaactgggtctcttcagttga

SEQ ID NO: 6568 - DNA, 575 bp, synthetic construct
  misc_feature 1..575: note = Synthetic polypeptide
  source 1..575: mol_type = other DNA
tgataggtttggctgtgtccccaccgaaatctcaacttgaattgtatctcccagaattcccacgtattgtgggagggacctaagaggaggtagttgaatcatgagggccagtttttctcgtgctagtctcgtgatagtaagtctcacgagatctgatgggtttatcaggggtctccgcttttgcttctttctcattttctcttgctgtcgctgcttaagaagagcctttcgcctcccaccatgattgtgagaactcctcagccatgtggaactagctggtgatgctgctggagtggtggtcgggcacggaatgcaccatcttcacggacccgcgcgcctacctcaagtatgggaaggaaaatgccatcgtggttctcaaccacaagtttgaaattgactttctgtgtggctggagcctgtccgaacgctttgggctgttaggggtaagtcagaagtgcattcccccctgcctcacacatttctctggttcagccccaccacttgtctttttgctcctggtcattcagaacttgcagaagaatcaacagagtttctacttgatgaaatggtcctaa

SEQ ID NO: 6569 - DNA, 292 bp, synthetic construct
  misc_feature 1..292: note = Synthetic polypeptide
  source 1..292: mol_type = other DNA
tggtgactttgaagagactgtcacctatcaccaagtgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtg

SEQ ID NO: 6570 - DNA, 460 bp, synthetic construct
  misc_feature 1..460: note = Synthetic polypeptide
  source 1..460: mol_type = other DNA
tggtgactttgaagagactgtcacctatcaccaagtgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6571 - DNA, 520 bp, synthetic construct
  misc_feature 1..520: note = Synthetic polypeptide
  source 1..520: mol_type = other DNA
tggtgactttgaagagactgtcacctatcaccaagtgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtggtgaggattggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctga

SEQ ID NO: 6572 - DNA, 412 bp, synthetic construct
  misc_feature 1..412: note = Synthetic polypeptide
  source 1..412: mol_type = other DNA
tggtgactttgaagagactgtcacctatcaccaagtgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6573 - DNA, 403 bp, synthetic construct
  misc_feature 1..403: note = Synthetic polypeptide
  source 1..403: mol_type = other DNA
tggtgactttgaagagactgtcacctatcaccaagtgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggcaagtggggtttggagatttggtggtccatgtgtggctaggcaggggcagttga

SEQ ID NO: 6574 - DNA, 445 bp, synthetic construct; identical to SEQ ID NO: 744
  misc_feature 1..445: note = Synthetic polypeptide
  source 1..445: mol_type = other DNA

SEQ ID NO: 6575 - DNA, 59 bp, synthetic construct; identical to SEQ ID NO: 742
  misc_feature 1..59: note = Synthetic polypeptide
  source 1..59: mol_type = other DNA

SEQ ID NO: 6576 - DNA, 123 bp, synthetic construct; identical to SEQ ID NO: 743
  misc_feature 1..123: note = Synthetic polypeptide
  source 1..123: mol_type = other DNA

SEQ ID NO: 6577 - DNA, 854 bp, synthetic construct
  misc_feature 1..854: note = Synthetic polypeptide
  source 1..854: mol_type = other DNA
gaagaacatggaaacactaggctgacttagtctcccagcctacatctttctcccatgctggacgctgcctgccctcaaacatcagactgcaagttcttcagcttttggactcttggacttacaccagtgatttgccaggagctctcaggccttcagcaacagactgaaggctgtgctgtcggcttccctacttttgaggttttgggactcagactggcttcctggctcttcagcttgcagatggcctattgtgggacttcaccttgtgatcatctcgcccgtgcttcgtgggggaatggagcccctggagtggttgtgcagaccagtgcaagcctacaacccgtgtgcggaggcgctcggtgcagcaggagcctcagaacggcggggcgccctgcccacccctggaagagagagctggctgcctggagtactccaccccgcagggccaggactgcgggcacacctatgttcctgcctttataactacctctgcattcaacaaggagagaacacgacaagctacgtctccacactggtctacacacacagaggatgctggatactgtatggagtttaagacagagtccttgactcctcactgtgctctggaaaactggcccttgactagatggatgcagtatctccgagagggatacacggtgtgtgtggattgtcagcctccagctatgaactctgtgagccttcgttgttctggagatggcctggactccgatggaaatcagactctccattggcaagcaattggtaatcctcggtgtcaaggaacttggaaaaaagttcggcgagtagaccagtgttcttgtccagctgttcacagttttatttttatatag

SEQ ID NO: 6578 - DNA, 558 bp, synthetic construct
  misc_feature 1..558: note = Synthetic polypeptide
  source 1..558: mol_type = other DNA
tcacttaccaacttactcaccaactcacccagagcaactgcccatgctgcacactccagtgctgagccccccaagatgaacccagtggtggagccactgtcctggatgctgggcacctggctgtcggacccacctggagccgggacctaccccacactgcagcccttccagtacctggaggaggttcacatctcccacgtgggccagcccatgctgaacttctcgttcaactccttccacccggacacgcgcaagccgatgcacagagagtgtggcttcattcgcctcaagcccgacaccaacaaggtggcctttgtcagcgcccagaacacaggcgtggtggaagtggaggagggcgaggtgaacgggcaggagctgtgcatcgcatcccactccatcgccaggatctccttcgccaaggagccccacgtagagcagatcacccggaagttcaggctgaattctgaaggcaaacttgagcagacggtctccatggcaaccacgacacagccaatgactcagcatcttcacgtcacctacaagaaggtgaccccgtaa

SEQ ID NO: 6579 - DNA, 639 bp, synthetic construct
  misc_feature 1..639: note = Synthetic polypeptide
  source 1..639: mol_type = other DNA
tcacttaccaacttactcaccaactcacccagagcaactgcccatgctgcacactccagtgctgagccccccaagatgaacccagtggtggagccactgtcctggatgctgggcacctggctgtcggacccacctggagccgggacctaccccacactgcagcccttccagtacctggaggaggttcacatctcccacgtgggccagcccatgctgaacttctcgttcaactccttccacccggacacgcgcaagccgatgcacagagagtgtggcttcattcgcctcaagcccgacaccaacaaggtggcctttgtcagcgcccagaacacaggcgtggtggaagtggaggagggcgaggtgaacgggcaggagctgtgcatcgcatcccactccatcgccaggatctccttcgccaaggagccccacgtagagcaggtgagcccagccctgctcccagcacgctcctgtcttctgtttgcagcggtctgtggagtcagcctcttcctcttccgtgagatcacccggaagttcaggctgaattctgaaggcaaacttgagcagacggtctccatggcaaccacgacacagccaatgactcagcatcttcacgtcacctacaagaaggtgaccccgtaa

SEQ ID NO: 6580 - DNA, 1775 bp, synthetic construct; identical to SEQ ID NO: 568
  misc_feature 1..1775: note = Synthetic polypeptide
  source 1..1775: mol_type = other DNA

SEQ ID NO: 6581 - DNA, 575 bp, synthetic construct
  misc_feature 1..575: note = Synthetic polypeptide
  source 1..575: mol_type = other DNA
ggccgggcgcagtggctcacacctgtaatcccagcactttggaacaccgagtcgcgcagaacacgagctacctctacccagatggaaagacccacaacccagacctgactgagctcggccaggcagaaccccagcagcgcatccacgtgtcagaggagcagctgcagctctactgggccatggactccacatttgagctctgcaagatctgtgctgagagcaacaaggatgtgaagattgagccgtgcgggcacctgctctgcagctgctgcctggctgcctggcagcactcggacagccagacctgccccttctgccgctgcgagatcaagggctgggaggccgtgagtatctaccagttccacggtcaggctactgctgaggactcagggaacagcagtgaccaggaaggcagggagttggagctggggcaggtgcccctttcggctcctccattgcccccacggccagatctgccccccaggaagcccagaaatgcccagccgaaagtgagactcctaaaggggaactcccctccagctgcgctgggaccccaggaccctgccccggcctga

SEQ ID NO: 6582 - DNA, 119 bp, synthetic construct
  misc_feature 1..119: note = Synthetic polypeptide
  source 1..119: mol_type = other DNA
ggctgggcaccgtggctcatggctgtaatccccagcactgtgggaggccaaggagggaggatcacctgaggtcaggagttcgagaccagcctggccaacatggcgagaccaggcgctga

SEQ ID NO: 6583 - DNA, 333 bp, synthetic construct
  misc_feature 1..333: note = Synthetic polypeptide
  source 1..333: mol_type = other DNA
ggccgggcgtggtggctcacacatgtaatcccagcactttgcgaggctgaggcgcgggcggtgatgaactttgtggttcgctaccggccagacgagcagccgtctctgcggccacaccacgactcatccaccttcaccctcaacgttgccctcaaccacaagggcctggactatgagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctga

SEQ ID NO: 6584 - DNA, 100 bp, synthetic construct
  misc_feature 1..100: note = Synthetic polypeptide
  source 1..100: mol_type = other DNA
tagaggacagcaagtaaagggcccaggagacaccagcgggggctgccgctgcagggtaaatgggattccttgccacccaagctgtcagaactgccactga

SEQ ID NO: 6585 - DNA, 174 bp, synthetic construct
  misc_feature 1..174: note = Synthetic polypeptide
  source 1..174: mol_type = other DNA
ccatcaccaagcggtgagactatcacctatcgccaagtggcgctgggtgtctacaatgtcagcaagacagcgctgctgggtctcactagaacactggcattggagctggcccccaaggacatccgggtaaactgcgtggttccaggaattatcaaaactgacttcagcaaagtg

SEQ ID NO: 6586 - DNA, 342 bp, synthetic construct
  misc_feature 1..342: note = Synthetic polypeptide
  source 1..342: mol_type = other DNA
ccatcaccaagcggtgagactatcacctatcgccaagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6587 - DNA, 402 bp, synthetic construct
  misc_feature 1..402: note = Synthetic polypeptide
  source 1..402: mol_type = other DNA
ccatcaccaagcggtgagactatcacctatcgccaagtggcgctgggtgtctacaatgtcagcaagacagcgctgctgggtctcactagaacactggcattggagctggcccccaaggacatccgggtaaactgcgtggttccaggaattatcaaaactgacttcagcaaagtggtgaggattggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctga

SEQ ID NO: 6588 - DNA, 294 bp, synthetic construct
  misc_feature 1..294: note = Synthetic polypeptide
  source 1..294: mol_type = other DNA
ccatcaccaagcggtgagactatcacctatcgccaagtggcgctgggtgtctacaatgtcagcaagacagcgctgctgggtctcactagaacactggcattggagctggcccccaaggacatccggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6589 - DNA, 285 bp, synthetic construct
  misc_feature 1..285: note = Synthetic polypeptide
  source 1..285: mol_type = other DNA
ccatcaccaagcggtgagactatcacctatcgccaagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggcaagtggggtttggagatttggtggtccatgtgtggctaggcaggggcagttga

SEQ ID NO: 6590 - DNA, 540 bp, synthetic construct
  misc_feature 1..540: note = Synthetic polypeptide
  source 1..540: mol_type = other DNA
tgtttctcctctagagtttaagttgcttgagggaggaatctgttcatcaccgtgtctctaacaccagcggagtgactgcacgcaccagctggtgctcaagaccgaatcggctgggcttttggcctaggattagaaaggctagccatgatcctctacgacatccctgatatccgtctcttctggtgtgaggacgagcgcttcctgaagcagttctgtgtatccaacattaatcagaaggtgaagtttcagcctcttagcaaatatccggctgtgatcaatgatatttcattctggttgccctctgagaattacgcagaaaatgatttctatgacttagtccgaacaattggaggagacctggtggaaaaggttgatctcatagacaagtttgtacatccaaagacgcacaagaccagccactgctaccgcatcacgtaccgccacatggaacggactctgtcccagagagaggtcaggcacatccaccaggccttgcaggaggctgcagtccagctgttgggtgtggagggcaggttctga

SEQ ID NO: 6591 - DNA, 557 bp, synthetic construct
  misc_feature 1..557: note = Synthetic polypeptide
  source 1..557: mol_type = other DNA
ctgggcacagtggctcacgcctgtaatcccagcactttgggaggccgaggcgggtggatcacgagatcaggagtttgagaccagcctgaccaacatggtgaaaccctgtctcttctaaagatacaaaaattagccgggcatggtggcacgcacctgtagtcccagctacttgtgaggctgaggcaggagaatcgcttgaatccgggaggcggaggttgcagtgagccgagatcatgccacttcactccagcctgagtgacagaaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatctga

SEQ ID NO: 6592 - DNA, 561 bp, synthetic construct
  misc_feature 1..561: note = Synthetic polypeptide
  source 1..561: mol_type = other DNA
cagggatgtcaatctgttttcatctcagatgccacctctaaccagttgatactgactctctggaatgctgtgttgacaggaatcctgagcccagagtcacttgccgcaggaaacggtatttctcaaagagactacacacaatactatgatcatatttctaaacaaaaggaagaaattcgcagatgcatacaagactttttcaagaaacacatacagtacaaattcttagatgaagactttgtgttcgatatatacagagacagtagggggaaggtgtggctcattgactttaatccatttggtgaagtcacagattcactgctgttcacctgggaagaactgatatctgagaacaacttaaacggcgattttagtgaagttgacgctcaagagcaggattccccagctttccgttgcacaaacagtgaagtgacagtccagcccagcccctatttgagttaccggctacccaaggactttgtagacctctctactggggaggacgctcacaagctaatagacttccttaagctgaagagaaatcagcaggaggacgactga

SEQ ID NO: 6593 - DNA, 196 bp, synthetic construct
  misc_feature 1..196: note = Synthetic polypeptide
  source 1..196: mol_type = other DNA
cagggatgtcaatctgttttcatctcagatgccacctctaaccagttgatactgactctctggaatgctgtgttgacaggaatcctgagcccagagtcacttgccgcaggaaacggtatttctcaaagagactacacacaatactatgatcatatttctaaacaaaaggaagaaattcgcagatgcatacaagact

SEQ ID NO: 6594 - DNA, 423 bp, synthetic construct
  misc_feature 1..423: note = Synthetic polypeptide
  source 1..423: mol_type = other DNA
cagggatgtcaatctgttttcatctcagatgccacctctaaccagttgatactgactctctggaatgctgtgttgacaggaatcctgagcccagagtcacttgccgcaggaaacggtatttctcaaagagactacacacaatactatgatcatatttctaaacaaaaggaagaaattcgcagatgcatacaagactttttcaagaaacacatacagtacaaattcttagatgaagactttgtgttcgatatatacagagacagtagggggaaggtgtggctcattgactttaatccatttggtgaagtcacagattcactgctgttcacctgggaagaactgatatctgagaacaacttaaacggcgattttagtgaagttgacgctcaagagcagaagagaaatcagcaggaggacgactga

SEQ ID NO: 6595 - DNA, 268 bp, synthetic construct
  misc_feature 1..268: note = Synthetic polypeptide
  source 1..268: mol_type = other DNA
ccatcaccaagcgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtg

SEQ ID NO: 6596 - DNA, 436 bp, synthetic construct
  misc_feature 1..436: note = Synthetic polypeptide
  source 1..436: mol_type = other DNA
ccatcaccaagcgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6597 - DNA, 496 bp, synthetic construct
  misc_feature 1..496: note = Synthetic polypeptide
  source 1..496: mol_type = other DNA
ccatcaccaagcgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtggtgaggattggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctga

SEQ ID NO: 6598 - DNA, 388 bp, synthetic construct
  misc_feature 1..388: note = Synthetic polypeptide
  source 1..388: mol_type = other DNA
ccatcaccaagcgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6599 - DNA, 379 bp, synthetic construct
  misc_feature 1..379: note = Synthetic polypeptide
  source 1..379: mol_type = other DNA
ccatcaccaagcgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggcaagtggggtttggagatttggtggtccatgtgtggctaggcaggggcagttga

SEQ ID NO: 6600 - DNA, 970 bp, synthetic construct; identical to SEQ ID NO: 711
  misc_feature 1..970: note = Synthetic polypeptide
  source 1..970: mol_type = other DNA

SEQ ID NO: 6601 - DNA, 476 bp, synthetic construct
  misc_feature 1..476: note = Synthetic polypeptide
  source 1..476: mol_type = other DNA
tgtctcacgcctgtatcccagcactttgagaggccaagggtatcagcatggaagccatgagtgagaataaaatggtgccctctgagtttagcacaggacctgtggaaaaagctgccaaacctttgccatttaaggatcccaactttgtgcactctggccacggtggcgcagtagctggcaagaagaacagaacctggaagaacctgaaacaaatcctcgcttctgaaagggcattgccgtggcaactgaacgatcctaactacttcagtattgatgctcctccatcctttaagccagctaagaagtattctgatgtttcaggtctgcttgaaccaccaaactgttttccacagaggctgcatcaattgacattcccactagcaatggatgagggttccaatttttccagatgctcaccaacacttgttaattttggttttgttttcattatggccattctggtgggtgtaaagtag

SEQ ID NO: 6602 - DNA, 461 bp, synthetic construct
  misc_feature 1..461: note = Synthetic polypeptide
  source 1..461: mol_type = other DNA
tgtctcacgcctgtatcccagcactttgagaggccaagggtatcagcatggaagccatgagtgagaataaaatggtgccctctgagtttagcacaggacctgtggaaaaagctgccaaacctttgccatttaaggatcccaactttgtgcactctggccacggtggcgcagtagctggcaagaagaacagaacctggaagaacctgaaacaaatcctcgcttctgaaagggcattgccgtggcaactgaacgatcctaactacttcagtattgatgctcctccatcctttaagccagctaagaagtattctgatgtttcaggtctgcttgccaactacacagacccccagagcaaactgcggttcagcaccattgaagagttttcctacattcggaggctgccctctgacgtcgtcaccggctacctggccctgaggaaggccacgagcatcgttccctga

SEQ ID NO: 6603 - DNA, 361 bp, synthetic construct
  misc_feature 1..361: note = Synthetic polypeptide
  source 1..361: mol_type = other DNA
tgtctcacgcctgtatcccagcactttgagaggccaagggtatcagcatggaagccatgagtgagaataaaatggtgccctctgagtttagcacaggacctgtggaaaaagctgccaaacctttgccatttaaggatcccaactttgtgcactctggccacggtggcgcagtagctggcaagaagaacagaacctggaagaacctgaaacaaatcctcgcttctgaaagggcattgccgtggcaactgaacgatcctaactacttcagtattgatgctcctccatcctttaagccagctaagaagtattctgatgtttcaggtctgcttgccaactacacagacccccagagcaaactgcg

SEQ ID NO: 6604 - DNA, 535 bp, synthetic construct
  misc_feature 1..535: note = Synthetic polypeptide
  source 1..535: mol_type = other DNA
tggtagattacgcagccataaaaaagaatgaagtcatgtcttttgtagcaacatggatgctgctggaagtgattatcctacatgaattaatgcagaaacagaaaatcacataccacatgttctcacttataaattggcagcgatgttcctgggaatggatttaccaggactgaatcttcctgattcatggaaaacctatgcaatgaccggattcgtagcctggcatgttgggactgaggttgttctggagttgaaatattggatgatgacagaattcagatccttcagtcatttactgcagtggaaacagagggtcatgcttttaaaaaggcagtgttggcaatttatgtctgtgggaatgttacttttctcatcatatttttatctgcaatcaaccatctatgagcaagcaaagaccttggcttttgcaggccaagtgataattatcatcaaaccaaagaaacttgaagcctgtcctgactgcctggagcatatttgtgaattctcacttggaagactggggtcatgtctgtag

SEQ ID NO: 6605 - DNA, 433 bp, synthetic construct
  misc_feature 1..433: note = Synthetic polypeptide
  source 1..433: mol_type = other DNA
tggtagattacgcagccataaaaaagaatgaagtcatgtcttttgtagcaacatggatgctgctggaagtgattatcctacatgaattaatgcagaaacagaaaatcacataccacatgttctcacttataaattggcagcgatgttcctgggaatggatttaccaggactgaatcttcctgattcatggaaaacctatgcaatgaccggattcgtagcctggcatgttgggactgaggttgttctggaggtacatgcttatcggctctctcgcaaagttgaaatattggatgatgacagaattcagatccttcagtcatttactgcagtggaaacagagggtcatgcttttaaaaaggcagtgttggcaatttatgtctgtgggaatgttacttttctcatcatatttttatctgcaatcaaccatctatga

SEQ ID NO: 6606 - DNA, 1688 bp, synthetic construct
  misc_feature 1..1688: note = Synthetic polypeptide
  source 1..1688: mol_type = other DNA
tcgccgtcctcagcaagacgtggcaaacaagatgcagtgaatctttggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatgtcagtgacctggagagtgtcacttccaaagagatccgccaggctctggagctgcgcctggggctccccctccagcagtaccgtgacttcatcgacaaccagatgctgctgctggtggcacagcgggaccgagcctcccgcatcttcccccacctctacctgggctcagagtggaacgcagcaaacctggaggagctgcagaggaacagggtcacccacatcttgaacatggcccgggagattgacaacttctaccctgagcgcttcacctaccacaatgtgcgcctctgggatgaggagtcggcccagctgctgccgcactggaaggagacgcaccgcttcattgaggctgcaagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagccgccagagccatgtctgggagcagaaagtgggtggggtctccccagaggagcacccagcccctgaagtctctacaccattcccacctcttccgccagaacctgagggtggtggggaggagaaggttgtaggcatggaagagagccaggcagccccgaaagaagagcctgggccacggccacgtataaacctccgaggggtcatgaggtccatcagtcttctggagccctccttggagctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggttccggaaggtggtgagacaggccagcgtgcatgacagtggagaggagggcgaggcctga

SEQ ID NO: 6607 - DNA, 893 bp, synthetic construct
  misc_feature 1..893: note = Synthetic polypeptide
  source 1..893: mol_type = other DNA
tcgccgtcctcagcaagacgtggcaaacaagatgcagtgaatctttggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggttccggaaggtggtgagacaggccagcgtgcatgacagtggagaggagggcgaggcctga

SEQ ID NO: 6608 - DNA, 1124 bp, synthetic construct
  misc_feature 1..1124: note = Synthetic polypeptide
  source 1..1124: mol_type = other DNA
tcgccgtcctcagcaagacgtggcaaacaagatgcagtgaatctttggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatgtcagtgacctggagagtgtcacttccaaagagatccgccaggctctggagctgcgcctggggctccccctccagcagtaccgtgacttcatcgacaaccagatgctgctgctggtggcacagcgggaccgagcctcccgcatcttcccccacctctacctgggctcagagtggaacgcagcaaacctggaggagctgcagaggaacagggtcacccacatcttgaacatggcccgggagattgacaacttctaccctgagcgcttcacctaccacaatgtgcgcctctgggatgaggagtcggcccagctgctgccgcactggaaggagacgcaccgcttcattgaggctgcaagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagaacctga

SEQ ID NO: 6609 - DNA, 661 bp, synthetic construct
  misc_feature 1..661: note = Synthetic polypeptide
  source 1..661: mol_type = other DNA
ccatcaccaagcggtgagactatcacctatcgccaagtggctttctgtgaggatgagcagcaccgggatagacaggaagggcgtcctggctaaccgggtagccgtggtcacggggtccaccagtgggatcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtg

SEQ ID NO: 6610 - DNA, 829 bp, synthetic construct
  misc_feature 1..829: note = Synthetic polypeptide
  source 1..829: mol_type = other DNA
ccatcaccaagcggtgagactatcacctatcgccaagtggctttctgtgaggatgagcagcaccgggatagacaggaagggcgtcctggctaaccgggtagccgtggtcacggggtccaccagtgggatcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6611 - DNA, 889 bp, synthetic construct
  misc_feature 1..889: note = Synthetic polypeptide
  source 1..889: mol_type = other DNA
ccatcaccaagcggtgagactatcacctatcgccaagtggctttctgtgaggatgagcagcaccgggatagacaggaagggcgtcctggctaaccgggtagccgtggtcacggggtccaccagtgggatcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtggtgaggattggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctga

SEQ ID NO: 6612 - DNA, 1305 bp, synthetic construct
  misc_feature 1..1305: note = Synthetic polypeptide
  source 1..1305: mol_type = other DNA
catttacaaaatattcaaaatatgcaaaacggtactataatatttataaatacatacatatataacaagcagaaagataggaataggaataataaacactaaattcaggcaagtggccgtcttggggacgcaaaaggaaatgtgttcaggaatgaatacctggaagcctcgctatctggaatatttttcttaagctgtgttgagggaagaccaacactgtcatctgaagttggaatcatcatctgtgatattgctaatccagcctcgcttgatgaaatggctaaacaggcaacagttgtcctcaattgcgtaggaccatatcggttttatggagaacctgtaataaaagcatgtattgaaaatggagccagttgtatcgacatcagtggagaacctcagtttctggaactaatgcaactgaagtatcatgagaaagctgcagacaaaggggtttatatcattggaagcagcggctttgactccattccagcagatctgggagtaatatataccagaaataaaatgaatggtactttgactgctgtggaaagtttcctgactatacattcaggacctgaggggttgagcattcatgatggtacctggaagtcagcaatttatggttttggagatcagagtaatttgagaaaactaagaaatgtatcaaatctgaaacctgtcccgctcattggtccaaaattgaagagaaggtggccaatttcttattgtcgggaactcaaaggttattccattccttttatgggatctgatgtgtctgttgtaaggaggactcaacgttacttgtatgaaaatttagaggaatcaccagttcagtatgctgcgtatgtaactgtgggaggcatcacctctgttattaagctgatgtttgcaggacttttctttttgttctttgtgaggtttggaattggaaggcaacttctcataaaattcccatggttcttctcctttggctatttttcaaaacaaggcccaacacaaaaacagattgatgctgcctcattcacgctgacattctttggtcaaggatacagccaaggcactggtacagataagaacaaaccaaatatcaaaatttgtactcaggtgaaaggaccagaggctggctatgtggctacccccatagctatggttcaggcagccatgactcttctaagtgatgcttctcatctgcctaaggcgggcggggtcttcacacctggagcagctttttccaaaacaaagttgattgacagactcaacaaacacggtattgagtttagtgttattagcagctctgaagtctaa

SEQ ID NO: 6613 - DNA, 1854 bp, synthetic construct
  misc_feature 1..1854: note = Synthetic polypeptide
  source 1..1854: mol_type = other DNA
ctctccctctccccctccccctccccctctccctctccccacggtctccctctccctctctttccagggtctccctctgatgcccagccgaagctggactgtactgctgccatctcggctcactgcaacctccccgcctgattctcctgcctcagcctgcagagtgcctgccattgcaggcacgcgccgccacgcctgactggttttcgtatttttttggtggagatggggtttcgctgtgttggccgggctagtctccagctcctaaccgcgagtgatccgccagcctcggcctccggaggtgccgggattgcagacggtgtctggttcaatcagtgctcaatggtgcccaggctggaatgcagtggcgtgatctcggctcgctacaacctccacctcccagccacctgccttggcctcccaaagtgccgagagtgcagcctctgcccggccgccaccccgtctgggaagtgaggagcgtctctgcctggccgcctatcgtctgggacgtgaggagcccctctgcgtggctgcccagtctggaaagtgaggagcgtctctgcccggtcgccatcccatctaggaagtgaggagcgcctcttcccggccgccatcccatctaggaagtgaggagcatctctgcctggccgcccttcttctgagatgtggggagcgcctttgccccaccgccctgtctgggatgtgaggagcgcctctgccaggccgcgaccccgtctgggaggaaccagtagatcctctaaaggaagaagccttattggtaaggttgatggcacatcccacgtcactggaaaaggagttacagttgaaacagtcttttctgtggatgagttttctgcatctgtcctcactggaaaactgaccactgtcttccttccaattgtctacacaattgtgtttgtggtgggtttgccaagtaacggcatggccctgtgggtctttcttttccgaactaagaagaagcaccctgctgtgatttacatggccaatctggccttggctgacctcctctctgtcatctggttccccttgaagattgcctatcacatacatggcaacaactggatttatggggaagctctttgtaatgtgcttattggctttttctatggcaacatgtactgttccattctcttcatgacctgcctcagtgtgcagaggtattgggtcatcgtgaaccccatggggcactccaggaagaaggcaaacattgccattggcatctccctggcaatatggctgctgattctgctggtcaccattcctttgtatgtcgtgaagcagaccatcttcattcctgccctgaacatcacgacctgtcatgatgttttgcctgagcagctcttggtgggagacatgttcaattacttcctctctctggccattggggtctttctgttcccagccttcctcacagcctctgcctatgtgctgatgatcagaatgctgcgatcttctgccatggatgaaaactcagagaagaaaaggaagagggccatcaaactcattgtcactgtcctggccatgtacctgatctgcttcactcctagtaaccttctgcttgtggtgcattattttctgattaagagccagggccagagccatgtctatgccctgtacattgtagccctctgcctctctacccttaacagctgcatcgacccctttgtctattactttgtttcacatgatttcagggatcatgcaaagaacgctctcctttgccgaagtgtccgcactgtaaagcagatgcaagtatccctcacctcaaagaaacactccaggaaatccagctcttactcttcaagttcaaccactgttaagacctcctattga

SEQ ID NO: 6614 - DNA, 873 bp, synthetic construct
  misc_feature 1..873: note = Synthetic polypeptide
  source 1..873: mol_type = other DNA
gccgggcgcggtggctcacgcctgtcatcccagcactctgggaggccgaggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctga

SEQ ID NO: 6615 - DNA, 207 bp, synthetic construct
  misc_feature 1..207: note = Synthetic polypeptide
  source 1..207: mol_type = other DNA
gccgggcgcggtggctcacgcctgtcatcccagcactctgggaggccgaggttggtgtcttgttccgctaccactcagcagtgggctgatctctccttggcccttgaagtcaaccagtccctgacagcagctgtgctttcgatctggggccacagacgagcaatggtcatgcctgacttggctgtatggaacctctcgctgatgtga

SEQ ID NO: 6616 - DNA, 763 bp, synthetic construct; identical to SEQ ID NO: 606
  misc_feature 1..763: note = Synthetic polypeptide
  source 1..763: mol_type = other DNA

SEQ ID NO: 6617 - DNA, 1084 bp, synthetic construct; identical to SEQ ID NO: 580
  misc_feature 1..1084: note = Synthetic polypeptide
  source 1..1084: mol_type = other DNA

SEQ ID NO: 6618 - DNA, 2448 bp, synthetic construct
  misc_feature 1..2448: note = Synthetic polypeptide
  source 1..2448: mol_type = other DNA
ctctccctctccctgtccctgtccctctccctctccccatggtttccctctccctctctttccacggtctccctctcatgccgagccgaagctggactatactgctgccatctcggctcactgcaacctccctgcctgattctcctgcctcagcctgcggagtgcctgcaattgcaggtgcgcgccgccacgcctgactggttttcgtatttttttggtggagacggggtttcgctgtgatggccaggctggtctccagctcctaaccgcgagtggtccgccagcctcggactcccgaggtgccgggattgcagacggagtctggttctctcagtgctcaatggcgcccaggctggagcgcagtggcgtgatctcggctcgctacaacctccacctcccagccgcctgccttggcctcccaaagtgccgagattgcagcctctgccaggccgccaccccgtctgggaagtgaggagcgtctctgcctggccgcccatcgtctgggacgtgaggagtccctctgcctggctgcccagtctggaaagtgaggagcgtctctgcccagccgccatcccatctcggaagtgaggagcgcctcttcccggccgccatcacatctaggaagtgaggagcgtctctgcccggccgcccatcgtctgggatgtggggagtgcctctgccccgccgccccgtctgggatgtgaggagcgcctctgcccggccgccaccccgtctgggaggtgaggagcgtctctgcccggccgccccgtctcagaagtgaggagaccctccgcccggcagccgccccgtatgagaagtgaggagcctctccacccggcagccgccccgtctgggaagtgaggagcatctccgcccggcagccaccccgtccgggagggaggtggggggtcagccccccgcccggccagccgccccgtccgggaggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaa

SEQ ID NO: 6619 - DNA, 1543 bp, synthetic construct
  misc_feature 1..1543: note = Synthetic polypeptide
  source 1..1543: mol_type = other DNA
ctctccctctccctgtccctgtccctctccctctccccatggtttccctctccctctctttccacggtctccctctcatgccgagccgaagctggactatactgctgccatctcggctcactgcaacctccctgcctgattctcctgcctcagcctgcggagtgcctgcaattgcaggtgcgcgccgccacgcctgactggttttcgtatttttttggtggagacggggtttcgctgtgatggccaggctggtctccagctcctaaccgcgagtggtccgccagcctcggactcccgaggtgccgggattgcagacggagtctggttctctcagtgctcaatggcgcccaggctggagcgcagtggcgtgatctcggctcgctacaacctccacctcccagccgcctgccttggcctcccaaagtgccgagattgcagcctctgccaggccgccaccccgtctgggaagtgaggagcgtctctgcctggccgcccatcgtctgggacgtgaggagtccctctgcctggctgcccagtctggaaagtgaggagcgtctctgcccagccgccatcccatctcggaagtgaggagcgcctcttcccggccgccatcacatctaggaagtgaggagcgtctctgcccggccgcccatcgtctgggatgtggggagtgcctctgccccgccgccccgtctgggatgtgaggagcgcctctgcccggccgccaccccgtctgggaggtgaggagcgtctctgcccggccgccccgtctcagaagtgaggagaccctccgcccggcagccgccccgtatgagaagtgaggagcctctccacccggcagccgccccgtctgggaagtgaggagcatctccgcccggcagccaccccgtccgggagggaggtggggggtcagccccccgcccggccagccgccccgtccgggaggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaacccca

SEQ ID NO: 6620 - DNA, 1468 bp, synthetic construct
  misc_feature 1..1468: note = Synthetic polypeptide
  source 1..1468: mol_type = other DNA
ctctccctctccctgtccctgtccctctccctctccccatggtttccctctccctctctttccacggtctccctctcatgccgagccgaagctggactatactgctgccatctcggctcactgcaacctccctgcctgattctcctgcctcagcctgcggagtgcctgcaattgcaggtgcgcgccgccacgcctgactggttttcgtatttttttggtggagacggggtttcgctgtgatggccaggctggtctccagctcctaaccgcgagtggtccgccagcctcggactcccgaggtgccgggattgcagacggagtctggttctctcagtgctcaatggcgcccaggctggagcgcagtggcgtgatctcggctcgctacaacctccacctcccagccgcctgccttggcctcccaaagtgccgagattgcagcctctgccaggccgccaccccgtctgggaagtgaggagcgtctctgcctggccgcccatcgtctgggacgtgaggagtccctctgcctggctgcccagtctggaaagtgaggagcgtctctgcccagccgccatcccatctcggaagtgaggagcgcctcttcccggccgccatcacatctaggaagtgaggagcgtctctgcccggccgcccatcgtctgggatgtggggagtgcctctgccccgccgccccgtctgggatgtgaggagcgcctctgcccggccgccaccccgtctgggaggtgaggagcgtctctgcccggccgccccgtctcagaagtgaggagaccctccgcccggcagccgccccgtatgagaagtgaggagcctctccacccggcagccgccccgtctgggaagtgaggagcatctccgcccggcagccaccccgtccgggagggaggtggggggtcagccccccgcccggccagccgccccgtccgggaggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctga

SEQ ID NO: 6621 - DNA, 2672 bp, synthetic construct
  misc_feature 1..2672: note = Synthetic polypeptide
  source 1..2672: mol_type = other DNA
ctctccctctccctgtccctgtccctctccctctccccatggtttccctctccctctctttccacggtctccctctcatgccgagccgaagctggactatactgctgccatctcggctcactgcaacctccctgcctgattctcctgcctcagcctgcggagtgcctgcaattgcaggtgcgcgccgccacgcctgactggttttcgtatttttttggtggagacggggtttcgctgtgatggccaggctggtctccagctcctaaccgcgagtggtccgccagcctcggactcccgaggtgccgggattgcagacggagtctggttctctcagtgctcaatggcgcccaggctggagcgcagtggcgtgatctcggctcgctacaacctccacctcccagccgcctgccttggcctcccaaagtgccgagattgcagcctctgccaggccgccaccccgtctgggaagtgaggagcgtctctgcctggccgcccatcgtctgggacgtgaggagtccctctgcctggctgcccagtctggaaagtgaggagcgtctctgcccagccgccatcccatctcggaagtgaggagcgcctcttcccggccgccatcacatctaggaagtgaggagcgtctctgcccggccgcccatcgtctgggatgtggggagtgcctctgccccgccgccccgtctgggatgtgaggagcgcctctgcccggccgccaccccgtctgggaggtgaggagcgtctctgcccggccgccccgtctcagaagtgaggagaccctccgcccggcagccgccccgtatgagaagtgaggagcctctccacccggcagccgccccgtctgggaagtgaggagcatctccgcccggcagccaccccgtccgggagggaggtggggggtcagccccccgcccggccagccgccccgtccgggaggtgaggggcgcctctgcccggccgcccctactgggaagtgaggagcccctctgcccggccagccgccccgtccgggagggaggtgggggggtcaggccccgcccggccagccgccccgtccgggagggaggtgggggggtcagccccccgtctggccagccgcccggtccgggagggaggtgggggggtcagccccccgcccggccagccgccccgtccgggaggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaa

SEQ ID NO: 6622 - DNA, 1767 bp, synthetic construct
  misc_feature 1..1767: note = Synthetic polypeptide
  source 1..1767: mol_type = other DNA
ctctccctctccctgtccctgtccctctccctctccccatggtttccctctccctctctttccacggtctccctctcatgccgagccgaagctggactatactgctgccatctcggctcactgcaacctccctgcctgattctcctgcctcagcctgcggagtgcctgcaattgcaggtgcgcgccgccacgcctgactggttttcgtatttttttggtggagacggggtttcgctgtgatggccaggctggtctccagctcctaaccgcgagtggtccgccagcctcggactcccgaggtgccgggattgcagacggagtctggttctctcagtgctcaatggcgcccaggctggagcgcagtggcgtgatctcggctcgctacaacctccacctcccagccgcctgccttggcctcccaaagtgccgagattgcagcctctgccaggccgccaccccgtctgggaagtgaggagcgtctctgcctggccgcccatcgtctgggacgtgaggagtccctctgcctggctgcccagtctggaaagtgaggagcgtctctgcccagccgccatcccatctcggaagtgaggagcgcctcttcccggccgccatcacatctaggaagtgaggagcgtctctgcccggccgcccatcgtctgggatgtggggagtgcctctgccccgccgccccgtctgggatgtgaggagcgcctctgcccggccgccaccccgtctgggaggtgaggagcgtctctgcccggccgccccgtctcagaagtgaggagaccctccgcccggcagccgccccgtatgagaagtgaggagcctctccacccggcagccgccccgtctgggaagtgaggagcatctccgcccggcagccaccccgtccgggagggaggtggggggtcagccccccgcccggccagccgccccgtccgggaggtgaggggcgcctctgcccggccgcccctactgggaagtgaggagcccctctgcccggccagccgccccgtccgggagggaggtgggggggtcaggccccgcccggccagccgccccgtccgggagggaggtgggggggtcagccccccgtctggccagccgcccggtccgggagggaggtgggggggtcagccccccgcccggccagccgccccgtccgggaggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaacccca

SEQ ID NO: 6623 - DNA, 1692 bp, synthetic construct
  misc_feature 1..1692: note = Synthetic polypeptide
  source 1..1692: mol_type = other DNA
ctctccctctccctgtccctgtccctctccctctccccatggtttccctctccctctctttccacggtctccctctcatgccgagccgaagctggactatactgctgccatctcggctcactgcaacctccctgcctgattctcctgcctcagcctgcggagtgcctgcaattgcaggtgcgcgccgccacgcctgactggttttcgtatttttttggtggagacggggtttcgctgtgatggccaggctggtctccagctcctaaccgcgagtggtccgccagcctcggactcccgaggtgccgggattgcagacggagtctggttctctcagtgctcaatggcgcccaggctggagcgcagtggcgtgatctcggctcgctacaacctccacctcccagccgcctgccttggcctcccaaagtgccgagattgcagcctctgccaggccgccaccccgtctgggaagtgaggagcgtctctgcctggccgcccatcgtctgggacgtgaggagtccctctgcctggctgcccagtctggaaagtgaggagcgtctctgcccagccgccatcccatctcggaagtgaggagcgcctcttcccggccgccatcacatctaggaagtgaggagcgtctctgcccggccgcccatcgtctgggatgtggggagtgcctctgccccgccgccccgtctgggatgtgaggagcgcctctgcccggccgccaccccgtctgggaggtgaggagcgtctctgcccggccgccccgtctcagaagtgaggagaccctccgcccggcagccgccccgtatgagaagtgaggagcctctccacccggcagccgccccgtctgggaagtgaggagcatctccgcccggcagccaccccgtccgggagggaggtggggggtcagccccccgcccggccagccgccccgtccgggaggtgaggggcgcctctgcccggccgcccctactgggaagtgaggagcccctctgcccggccagccgccccgtccgggagggaggtgggggggtcaggccccgcccggccagccgccccgtccgggagggaggtgggggggtcagccccccgtctggccagccgcccggtccgggagggaggtgggggggtcagccccccgcccggccagccgccccgtccgggaggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctga

SEQ ID NO: 6624 - DNA, 507 bp, synthetic construct; identical to SEQ ID NO: 881
  misc_feature 1..507: note = Synthetic polypeptide
  source 1..507: mol_type = other DNA

SEQ ID NO: 6625 - DNA, 459 bp, synthetic construct
  misc_feature 1..459: note = Synthetic polypeptide
  source 1..459: mol_type = other DNA
caggggttcccaaccccctggtatcaggtctgtggcctgttaagaaccaggtcacacagcaggaggtgaacagtgggtgagccagcaaagcttcatctgtatttacagccacaatctgagctctgccttccgtcagatcaacacagacgttcgattctcataggaactcaaaccctattacaaactgcacatgcgaggaatctaggctacgtgctccttatgaaaatctaatgcctgatgatctgtcactgtctcccatcacccccagatgtgaccatctagttgcaggaaaacaagctcagggctgtcactgattccacattgtgagaaggatgccgcatagagaatgtactgaagaatatcaaatgcagaaagtatgctttcaacatgctacagctgatggctttccccaagtactacagacctccagaggggacttatggaaaagctgacacctaa

SEQ ID NO: 6626 - DNA, 829 bp, synthetic construct
  misc_feature 1..829: note = Synthetic polypeptide
  source 1..829: mol_type = other DNA
gagggaggagccaagatggccgaataggaacagctccggtctacagctcccaggatgagcgacgcagaagacgggtgatttctgcatttccatctgaggtaccgggttcatctcactagggagtgccagacagtgggcgcaggctggaagtgatggagagagtattggaaactgtcccttttgccaacgccttttcatgatcctctggcttaaaggagttaaatttaatgtgacaactgttgacatgaccagaaagcctgaagaactaaaggacttagccccaggtaccaatcctccgttcctggtgtataacaaggagttgaaaacagacttcattaaaattgaggagtttttagaacaaaccctggctcctccaaggtaccctcacctgagtcccaagtacaaggagtcttttgatgtgggctgtaacctctttgccaagttttctgcatacattaagaatacacaaaaggaggcaaataagaattttgaaaaatctctgctcaaagaattcaagcgtctggatgactacttaaacaccccacttctggatgaaattgatccagacagtgctgaggaacccccagtttccagaagactattcttggatggggaccagctaacactggctgattgtagcttgttacccaagctgaacattattaaagttgctgccaagaaatatcgtgactttgacattccagcagaattctcaggagtctggcgttatctccacaatgcctatgcccgtgaagaatttacccacacgtgtcctgaagacaaagaaattgaaaatacttacgcaaatgtggctaaacagaagagttag

SEQ ID NO: 6627 - DNA, 484 bp, synthetic construct
  misc_feature 1..484: note = Synthetic polypeptide
  source 1..484: mol_type = other DNA
gagggaggagccaagatggccgaataggaacagctccggtctacagctcccaggatgagcgacgcagaagacgggtgatttctgcatttccatctgaggtaccgggttcatctcactagggagtgccagacagtgggcgcaggctggaagtgatggagagagtattggaaactgtcccttttgccaacgccttttcatgatcctctggcttaaaggagttaaatttaatgtgacaactgttgacatgaccaggtaccctcacctgagtcccaagtacaaggagtcttttgatgtgggctgtaacctctttgccaagttttctgcatacattaagaatacacaaaaggaggcaaataagaattttgaaaaatctctgctcaaagaattcaagcgtctggatgactacttaaacaccccacttctggatgaaattgatccagacagtgctgaggaacccccagtttccagaagactattcttggat

SEQ ID NO: 6628 - DNA, 238 bp, synthetic construct
  misc_feature 1..238: note = Synthetic polypeptide
  source 1..238: mol_type = other DNA
gaacatgttccctctgagatcacagatgagacgttcttgctatcaccacttgcatttcacattggactgaacgttctatccagtgcaaatcctagccaggcaagagaaagttaaacccttctcaggcaccaccccatccaggaaaccactccccaagaggaagaacacgtggaacttcctgaaatgcgcctacatggtgatgacctacctcttcgtatcctacaacaaaggggactgg

SEQ ID NO: 6629 - DNA, 2504 bp, synthetic construct
  misc_feature 1..2504: note = Synthetic polypeptide
  source 1..2504: mol_type = other DNA
gtgagaggtcacagcgtgctggcagtcctcacagccctcgctcgctctcggcgcctcctctgcctgggctcccactttggcggcacttgaggagctcttcagcccaccgctgcactgtaggagcccctttctgggctggccaaggtcggagccggctccctcagcttgcagggaggtgtggagggagaggcgtgagccggaaccagggctgcgcgcagcgcttgcgggccagctagagttcccggtgagcatgggcttggcgggccccgcactcggagcagccggccggccctgccggccccgggcaatgaggggcttagcacccagccagcagctgcggagggggttctaggtcccccagtagtgccggcctaccggcactgcgctcgatttctcgctgggccttagctgccttcccctggggcagggctcgggacctgcagcccgccatgcctgagcctcccaccccctccgtgggctcctgtgtggccccagcctccttgacgagcgccactccctgctccacggcgcccagtcccatcgaccacccaagggctgaggagtgcaggcgcacagcgcaggactggcaggcagctccagtcctgcaggcagctccacccgcagccccggtgcgggatccactgggtgaagccagctgggctcctgagtctggtggagccttggagaacctttatgtgtagctcagggattgtaaatacaccaatcggcactctgtatctagctcaaggtttgtaaacacaccaatcagcaccctgtgtctagctcagggtttctgagtgcaccaatcgacactctgtatctcgctgctctggtgggggcttggagaacctttgtgtggatactctgtatctaactaatctgatggggacgtggagaacctttgtgtctagctcagggattgtaaacgcaccaatcagcgccctgacaaaacagaccacttggctctaccaatcagcaggatgtgggtggggccagataagagaataaaagcaggctgccagagcaagcagtggcaacacgctcgggtccccttccacactgtggaagctttgttctttcgctctttgcaataaatcttgctactgctcactctttgggtccacgctgcttttatgagctgtgacactcaccacgaaggtctgcagcttcactcctgaagccagtgagaccacgagcccaccgggaggaacgaacaactccggacgcgctgccttaagagctgtaacactcactgtgaaggtctgcagcttcactcctgagccagcgagaccacgaacgcaccagaaggaagaaattccggacacatccgaacatcagaaggaacaaactccagacgtgctaccttaagagctgtaacactcaccgcgagggtccgcggcttcattcttgaagtgacttctgggggaacagaaagcatactgatggcctgcaaagcatatcgggatctggcctttgagaaggggatcaaaactccagaaattgtggctccccaaagtgcccatgctgcatttaacaaagcagccagttactttgggatgaagattgtgcgggtcccattgacgaagatgatggaggtggatgtgcgggcaatgagaagagctatctccaggaacactgccatgctcgtctgttctaccccacagtttcctcatggtgtaatagatcctgtccctgaagtggccaagctggctgtcaaatacaaaataccccttcatgtcgacgcttgtctgggaggcttcctcatcgtctttatggagaaagcaggatacccactggagcacccatttgatttccgggtgaaaggtgtaaccagcatttcagctgacacccataagtatggctatgccccaaaaggctcatcattggtgttgtatagtgacaagaagtacaggaactatcagttcttcgtcgatacagattggcagggtggcatctatgcttccccaaccatcgcaggctcacggcctggtggcattagcgcagcctgttgggctgccttgatgcacttcggtgagaacggctatgttgaagctaccaaacagatcatcaaaactgctcgcttcctcaagtcagaactggaaaatatcaaaggcatctttgtttttgggaatccccaattgtcagtcattgctctgggatcccgtgattttgacatctaccgactatcaaacctgatgactgctaaggggtggaacttgaaccagttgcagttcccacccagtattcatttctgcatcacattactacacgcccggaaacgagtagctatacaattcctaaaggacattcgagaatctgtcactcaaatcatgaagaatcctaaagcgaagaccacaggaatgggtgccatctatggcatggcccagacaactgttgacaggaatatggttgcagaattgtcctcagtcttcttggacagcttgtacagcaccgacactgtcacccagggcagccagatgaatggttctccaaaaccccactga

SEQ ID NO: 6630 - DNA, 411 bp, synthetic construct
  misc_feature 1..411: note = Synthetic polypeptide
  source 1..411: mol_type = other DNA
tggtagtttaaaaatggccacagattcttcatagctcctcccatcaagaggtggtctgatttttcaccctttgtattcaggttggcctttgtcatttgttttgaccaatagaatatagcaaaaaatgacatgtgatttctgaacctaggcctcaagaagcattgcagcttcagctcttaccttcttagatccttgagtccaccaagtgaagaagactaagctctcctcctgacggaagaaacaccaagtagagagaggcctagctatcccagcttaggccctagtgaggccatcctggactacccagctcagaataaccaccctaccaatccacagaaaagtggatctccttacgtagcagccaaaataaatgaagcaaaagacttgctagaaacaaccaccaaacattga

SEQ ID NO: 6631 - DNA, 1267 bp, synthetic construct
  misc_feature 1..1267: note = Synthetic polypeptide
  source 1..1267: mol_type = other DNA
tttcccccagagccatttgtttaccttcaatgattgtgaaagtccccttcccagggaggacttgtttacattccaggttctctcctctctctggaagggaggagggccacatatgtcaaccattctatataagctctgagtctcataatttcagagttcttctctgtagcgcagaccccactgcatatgcaggtgaattgaacatctgaccttcatcacattgtccttgggacatggaaactgactcaaggcatggtttataaggcgagagcattttgggggggccatggtgtggacattggacatggatgacgtcaggggcacgttctgtggcactggccctttcccccttgtctacgtattgaatgatatcctggtgcgggctgagttcagttcaacttctttaccacaattttggctgtcatctgctgtgaattcttcaagcactgaccctgaaaggctggctgtgaccacggcatggaccactgatagtaagattttgcccccaggaggagaggctggggtcactgagatccacggaaagtgtgaaaatatgactataacccctagaggtacaactgtgacccctacaaaggaaactgtatcccttggaaagcacactgtagctctaggagagaagactgagatcactggggcaatgaccatgacttctgtgggtcatcagtccatgacccctggagagaaggccctgacccctgtgggtcatcaatctgtgaccactggacagaagaccctgacctctgtgggttatcagtctgtgacccctggggaaaagaccctgacccctgtgggtcatcagtctgtgacccctgtgagtcatcagtctgtgagccctggaggaacgactatgacccctgtccattttcagactgagacccttagacagaatacagtggcccctagaaggaaggctgtggcccgtgaaaaggtgactgtcccctccagaaacatatcagtcacccctgaagggcagactatgcctttaagaggggagaatttgacttctgaggtgggcactcaccccaggatgggtaacttgggtcttcagatggaagctgaaaacaggatgatgctgtcctccagccccgtcatccagctcccggaacaaactcctctagcttttgacaaccgctttgttcccatctatggaaaccattcctctgtcaactcagtaacccctcaaacaagtcctctttctctaaaaaaagaaatcccagaaaactctgctgtggatgaagaagcctaa

SEQ ID NO: 6632 - DNA, 263 bp, synthetic construct
  misc_feature 1..263: note = Synthetic polypeptide
  source 1..263: mol_type = other DNA
tttcccccagagccatttgtttaccttcaatgattgtgaaagtccccttcccagggaggacttgtttacattccaggttctctcctctctctggaagggaggagggccacatatgtcaaccattctatataagctctgagtctcataatttcagagttcttctctgtagcgcagaccccactgcatatgcaggtgaattgaacatctgaccttcatcacattgtccttgggacatggaaactgactcaaggcatggtttataa

SEQ ID NO: 6633 - DNA, 493 bp, synthetic construct
  misc_feature 1..493: note = Synthetic polypeptide
  source 1..493: mol_type = other DNA
tgggaggctgaggcaggtggagcacttgagatcaggagtttcagaccagcctggccaacatggcaaaaccccctctctaccataaaaatagaaacattagctgggcatggtggcgtgtgcccataatctcagctactcaggaggctgaaacaggaggatcgcttgagcccatgaggttgcactgagccaagatcatgccattgcactcagcctaggcaacagagctaaagaattacctccaaagccattgtcaagaccacagcagtcatctgcaccagtccagctgaactctggctctcaaagcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaa

SEQ ID NO: 6634 - DNA, 550 bp, synthetic construct
  misc_feature 1..550: note = Synthetic polypeptide
  source 1..550: mol_type = other DNA
tgggaggctgaggcaggtggagcacttgagatcaggagtttcagaccagcctggccaacatggcaaaaccccctctctaccataaaaatagaaacattagctgggcatggtggcgtgtgcccataatctcagctactcaggaggctgaaacaggaggatcgcttgagcccatgaggttgcactgagccaagatcatgccattgcactcagcctaggcaacagagctaaagaattacctccaaagccattgtcaagaccacagcagtcatctgcaccagtccagctgaactctggctctcaaagtaacagaaatgaatataagctctatcctggactttccagctatcatgagagagttggcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaa

SEQ ID NO: 6635 - DNA, 346 bp, synthetic construct
  misc_feature 1..346: note = Synthetic polypeptide
  source 1..346: mol_type = other DNA
tgggaggctgaggcaggtggagcacttgagatcaggagtttcagaccagcctggccaacatggcaaaaccccctctctaccataaaaatagaaacattagctgggcatggtggcgtgtgcccataatctcagctactcaggaggctgaaacaggaggatcgcttgagcccatgaggttgcactgagccaagatcatgccattgcactcagcctaggcaacagagctaaagaattacctccaaagccattgtcaagaccacagcagtcatctgcaccagtccagctgaactctggctctcaaagtaaatatttttgttgcaattcaaatacagttgtaattaagtaa

SEQ ID NO: 6636 - DNA, 375 bp, synthetic construct; identical to SEQ ID NO: 860
  misc_feature 1..375: note = Synthetic polypeptide
  source 1..375: mol_type = other DNA

SEQ ID NO: 6637 - DNA, 255 bp, synthetic construct; identical to SEQ ID NO: 862
  misc_feature 1..255: note = Synthetic polypeptide
  source 1..255: mol_type = other DNA

SEQ ID NO: 6638 - DNA, 1052 bp, synthetic construct; identical to SEQ ID NO: 447
  misc_feature 1..1052: note = Synthetic polypeptide
  source 1..1052: mol_type = other DNA

SEQ ID NO: 6639 - DNA, 1118 bp, synthetic construct; identical to SEQ ID NO: 448
  misc_feature 1..1118: note = Synthetic polypeptide
  source 1..1118: mol_type = other DNA

SEQ ID NO: 6640 - DNA, 785 bp, synthetic construct
  misc_feature 1..785: note = Synthetic polypeptide
  source 1..785: mol_type = other DNA
attatatgtatataagttttcatccacagttcctggcctataactcccatagcccttttacagtcatctgttataatgttgggacactttaggccttagaaacaggcctcaggaagcagaatttctctctctctgacctctcctgccctcctttcacctgcccaaggcagggttctaatctaattgtgggtcataagaccctcattccagagagggccctgccccataccctggagggaaggaatgctgcacagaaaggccgaaaagaatctgagcagacaggccctgatggattccaccctcggtctgttagtattaaatcataccctttttgcccaatcacattttgacatggttgtccatgctttagtcatgcttatccaacgagtgtataaaaggcccaagaagacaaggttcagagagcttccggatagctgaacgcatggaggctgacaggacagtgaaggagaactcatccacgcgctgggcgagtggtgcaccccaactccacaggaacggaagctcctccagatcttgccttgtgttatctttccatctggctatttatttgcatcctttttaaatattcctcggacaccacaccctgctgctttgcctacattgcccgcccactgccccgtgcccacatcaaggagtatttctacaccagtggcaagtgctccaacccagcagtcgtctttgtcacccgaaagaaccgccaagtgtgtgccaacccagagaagaaatgggttcgggagtacatcaactctttggagatgagctag

SEQ ID NO: 6641 - DNA, 974 bp, synthetic construct
  misc_feature 1..974: note = Synthetic polypeptide
  source 1..974: mol_type = other DNA
attatatgtatataagttttcatccacagttcctggcctataactcccatagcccttttacagtcatctgttataatgttgggacactttaggccttagaaacaggcctcaggaagcagaatttctctctctctgacctctcctgccctcctttcacctgcccaaggcagggttctaatctaattgtgggtcataagaccctcattccagagagggccctgccccataccctggagggaaggaatgctgcacagaaaggccgaaaagaatctgagcagacaggccctgatggattccaccctcggtctgttagtattaaatcataccctttttgcccaatcacattttgacatggttgtccatgctttagtcatgcttatccaacgagtgtataaaaggcccaagaagacaaggttcagagagcttccggatagctgaacgcatggaggctgacaggacagtgaaggagaactcatccacgcgctgggcgagtggtgcaccccaactccacaggaacggaagctcctccagatcttgccttgtgttatctttccatctggctatttatttgcatcctttttaaatattcctcggacaccacaccctgctgctttgcctacattgcccgcccactgccccgtgcccacatcaaggagtatttctacaccagtggcaagtgctccaacccagcagtcgtccacaggtcaaggatgccaaagagagagggacagcaagtctggcaggatttcctgtatgactcccggctgaacaagggcaagctttgtcacccgaaagaaccgccaagtgtgtgccaacccagagaagaaatgggttcgggagtacatcaactctttggagatgagctaggatggagagtccttgaacctgaacttacacaaatttgcctgtttctgcttgctcttgtcctagcttgggaggcttcccctcactatcctaccccacccgctccttga

SEQ ID NO: 6642 - DNA, 785 bp, synthetic construct
  misc_feature 1..785: note = Synthetic polypeptide
  source 1..785: mol_type = other DNA
gagggaggagccaagatggccgaataggaacagctccggtctacagctcccaggatgagcgacgcagaagacgggtgatttctgcatttccatctgaggctggaagtgatggagagagtattggaaactgtcccttttgccaacgccttttcatgatcctctggcttaaaggagttaaatttaatgtgacaactgttgacatgaccagaaagcctgaagaactaaaggacttagccccaggtaccaatcctccgttcctggtgtataacaaggagttgaaaacagacttcattaaaattgaggagtttttagaacaaaccctggctcctccaaggtaccctcacctgagtcccaagtacaaggagtcttttgatgtgggctgtaacctctttgccaagttttctgcatacattaagaatacacaaaaggaggcaaataagaattttgaaaaatctctgctcaaagaattcaagcgtctggatgactacttaaacaccccacttctggatgaaattgatccagacagtgctgaggaacccccagtttccagaagactattcttggatggggaccagctaacactggctgattgtagcttgttacccaagctgaacattattaaagttgctgccaagaaatatcgtgactttgacattccagcagaattctcaggagtctggcgttatctccacaatgcctatgcccgtgaagaatttacccacacgtgtcctgaagacaaagaaattgaaaatacttacgcaaatgtggctaaacagaagagttag

SEQ ID NO: 6643 - DNA, 440 bp, synthetic construct
  misc_feature 1..440: note = Synthetic polypeptide
  source 1..440: mol_type = other DNA
gagggaggagccaagatggccgaataggaacagctccggtctacagctcccaggatgagcgacgcagaagacgggtgatttctgcatttccatctgaggctggaagtgatggagagagtattggaaactgtcccttttgccaacgccttttcatgatcctctggcttaaaggagttaaatttaatgtgacaactgttgacatgaccaggtaccctcacctgagtcccaagtacaaggagtcttttgatgtgggctgtaacctctttgccaagttttctgcatacattaagaatacacaaaaggaggcaaataagaattttgaaaaatctctgctcaaagaattcaagcgtctggatgactacttaaacaccccacttctggatgaaattgatccagacagtgctgaggaacccccagtttccagaagactattcttggat

SEQ ID NO: 6644 - DNA, 1759 bp, synthetic construct
  misc_feature 1..1759: note = Synthetic polypeptide
  source 1..1759: mol_type = other DNA
tctgaccctgcaggcctcccagccctctcccttggcacctgtctctgctctggtcacaccttgctctctccagttctgaaggcgccctgtgcctgtgtgcaccacattctcagtccttcacatctgtctttgcacgaaattgccggccctgcactggagcccagcccctcacctaccttgactactcctggtgacaacctcccagctggcagtgccgcccaccacgtgcactgtgctgctgctggcagagagcgagggggagcgggaacgctggctgcaggtgctgggtgagctgcagcggctgctgctggacgcgcggccaagaccccggcccgtgtacacactcaaggaggcttacgacaacgggctgccgctgctgcctcacacgctctgcgctgccatcctcgaccaggatcgacttgcgcttggcaccgaggaggggctctttgtcatccatctgcgcagcaacgacatcttccaggtgggggagtgccggcgcgtgcagcagctgaccttgagccccagtgcaggcctgctggtcgtgctgtgtggccgcggccccagcgtgcgtctctttgccctggcggagctggagaacatagaggtagcaggtgccaagatccccgagtctcgaggctgccaggtgctggcagctggaagcatcctgcaggcccgcaccccggtgctctgtgtagccgtcaagcgccaggtgctctgctaccagctgggcccgggccctgggccctggcagcgccgcatccgtgagctgcaggcacctgccactgtgcagagcctggggctgctgggcgaccggctatgtgtgggcgccgccggtggctttgcactctacccgctgctcaacgaggctgcgccgttggcgctgggggccggtttggtgcctgaggagctgccaccatcccgcgggggcctgggtgaggcactgggtgccgtggagcttagcctcagcgagttcctgctactcttcaccactgctggcatctacgtggatggcgcaggccgcaagtctcgtggccacgagctgttgtggccagcagcgcccatgggctgggggtatgcggccccctacctgacagtgttcagcgagaactccatcgatgtgtttgacgtgaggagggcagaatgggtgcagaccgtgccgctcaagaaggtgcggcccctcaatccagagggctccctgttcctctacggcaccgagaaggtccgcctgacctacctcaggaaccagctggcagagaaggacgagttcgacatcccggacctcaccgacaacagccggcgccagctgttccgcaccaagagcaagcgccgcttctttttccgcgtgtcggaggagcagcagaagcagcagcgcagggagatgctgaaggacccttttgtgcgctccaagctcatctcgccgcctaccaacttcaaccacctagtacacgtgggccctgccaacgggcggcccggcgccagggacaagtccccggctcccgaagagaagggccgagttgcccgcggctccggcccacagcggccccacagcttctccgaggcgttgcggcgcccagcctccatgggcagcgaaggcctcggtggagacgcagaccccatgaagaggaaaccctggacatccctgtccagcgagtctgtgtcctgcccccagggatcgctgagccctgcaacctccctaatgcaggtctcagaacggccccgaagcctccccctatcccctgaattggagagctctccttga

SEQ ID NO: 6645 - DNA, 308 bp, synthetic construct
  misc_feature 1..308: note = Synthetic polypeptide
  source 1..308: mol_type = other DNA
taggtgtcagccactatgcccagcccgccctctgactttccatctcccaccccacttatttttcttcaaaccacttatctctgcctgaccctgcacgacagatcgtgtttgctgactggcacagcctccaggttggcgggctcatctgcgctggggttctgtgcgccatgggcatcatcatcgtcatgagtgagtggaggagctcgggggagcaggcgggccggggctggggctcccctcccctgaccactcagctctccccaacaggtgcaaaatgcaaatgcaagtttggccagaagtccgggtaa

SEQ ID NO: 6646 - DNA, 281 bp, synthetic construct
  misc_feature 1..281: note = Synthetic polypeptide
  source 1..281: mol_type = other DNA
taggtgtcagccactatgcccagcccgccctctgactttccatctcccaccccacttatttttcttcaaaccacttatctctgcctgaccctgcacgacagatcgtgtttgctgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctga

SEQ ID NO: 6647 - DNA, 359 bp, synthetic construct
  misc_feature 1..359: note = Synthetic polypeptide
  source 1..359: mol_type = other DNA
taggtgtcagccactatgcccagcccgccctctgactttccatctcccaccccacttatttttcttcaaaccacttatctctgcctgaccctgcacgacagatcgtgtttgctgactggcacagcctccaggttggcgggctcatctgcgctggggttctgtgcgccatgggcatcatcatcgtcatgagtgagtggaggagctcgggggagcaggcgggccggggctggggctcccctcccctgaccactcagctctccccaacaggtgcaaaatgcaaatgcaagtttggccagaagtccggtcaccatccaggggagactccacctctcatcaccccaggctcagcccaaagctga

SEQ ID NO: 6648 - DNA, 230 bp, synthetic construct
  misc_feature 1..230: note = Synthetic polypeptide
  source 1..230: mol_type = other DNA
taggtgtcagccactatgcccagcccgccctctgactttccatctcccaccccacttatttttcttcaaaccacttatctctgcctgaccctgcacgacagatcgtgtttgctgactggcacagcctccaggttggcgggctcatctgcgctggggttctgtgcgccatgggcatcatcatcgtcatgagtgcaaaatgcaaatgcaagtttggccagaagtccgggtaa

SEQ ID NO: 6649 - DNA, 456 bp, synthetic construct
  misc_feature 1..456: note = Synthetic polypeptide
  source 1..456: mol_type = other DNA
tcctaagacatggacctgaccaccccactctgctgctgtgtactcttcaatgcctccccccaaaatttttgtgttaaaatcatagcctttgatgagctgcggaccgacttcaagaaccccatcgaccaggggaaccctgcgcgggcacgcgagcgtttaaaaaacatcgaacgcatctgctgcctcctgaggaagctggtggtcccagaatactccatccacggcctcttctgtctgatgtttctgtgtgcagcagagtgggtgaccctgggcctcaacatccccctcctcttctaccacctctggaggtacttccaccgtcctgcagatggctctgaggtcatgtatgatgcggtctccatcatgaatgctgacattctcaactactgccagaaggagtcctggtgcaaacttgccttctacctgctctccttcttctattacctgtacaggtga

SEQ ID NO: 6650 - DNA, 480 bp, synthetic construct
  misc_feature 1..480: note = Synthetic polypeptide
  source 1..480: mol_type = other DNA
tcctaagacatggacctgaccaccccactctgctgctgtgtactcttcaatgcctccccccaaaatttttgtgttaaaatcatagcctttgatgagctgcggaccgacttcaagaaccccatcgaccaggggaaccctgcgcgggcacgcgagcgtttaaaaaacatcgaacgcatctgctgcctcctgaggaagctggtggtcccagaatactccatccacggcctcttctgtctgatgtttctgtgtgcagcagagtgggtgaccctgggcctcaacatccccctcctcttctaccacctctggaggtacttccaccgtcctgcagatggctctgaggtcatgtatgatgcggtctccatcatgaatgctgacattctcaactactgccagaaggagtcctggtgcaaacttgccttctacctgctctccttcttctattacctgtacagtatggtttatacgttggtgagtttctaa

SEQ ID NO: 6651 - DNA, 186 bp, synthetic construct
  misc_feature 1..186: note = Synthetic polypeptide
  source 1..186: mol_type = other DNA
tcctaagacatggacctgaccaccccactctgctgctgtgtactcttcaatgcctccccccaaaatttttgtgttaaaatcatagcctttgatgagctgcggaccgacttcaagaaccccatcgaccaggggaaccctgcgcgggcagtaagtgatacatgtgctgtgccgagcgcgagcgtttaa

SEQ ID NO: 6652 - DNA, 1079 bp, synthetic construct
  misc_feature 1..1079: note = Synthetic polypeptide
  source 1..1079: mol_type = other DNA
caccgtctccctctgatgccgagccgaggctggactgtactgccaccatcttgactcactgcaacctccctgcctgattctcctgcctcagtctgccgagttcctgggattgcaggattttctgccgtctcttggcaaaaatggcaaataatgatgctgttctgaagagactggagcagaagggtgcagaggcagatcaaatcattgaatatcttaagcagcaagtttctctacttaaggagaaagcaattttgcaggcaactttgagggaagagaagaaacttcgagttgaaaatgctaaactgaagaaagaaattgaagaactgaaacaagagctaattcaggcagaaattcaaaatggagtgaagcaaataccatttccatctggtactccactgcacgctaattctatggtttctgaaaatgtgatacagtctacagcagtaacaaccgtatcttctggtaccaaagaacagataaaaggaggaacaggagacgaaaagaaagcgaaagagaaaattgaaaagaaaggagagaagaaggagaaaaaacagcaatcaatagctggaagtgccgactctaagccaatagatgtttcccgtctggatcttcgaattggttgcatcataactgctagaaaacaccctgatgcagattctttgtatgtggaagaagtagatgtcggagaaatagccccaaggacagttgtcagtggcctggtgaatcatgttcctcttgaacagatgcaaaatcggatggtgattttactttgtaacctgaaacctgcaaagatgaggggagtattatctcaagcaatggtcatgtgtgctagttcaccagagaaaattgaaatcttggctcctccaaatgggtctgttcctggagacagaattacttttgatgctttcccaggagagcctgacaaggagctgaatcctaagaagaagatttgggagcagatccagcctgatcttcacactaatgatgagtgtgtggctacatacaaaggagttccctttgaggtgaaagggaagggagtatgtagggctcaaaccatgagcaacagtggaatcaaataa

SEQ ID NO: 6653 - DNA, 1222 bp, synthetic construct
  misc_feature 1..1222: note = Synthetic polypeptide
  source 1..1222: mol_type = other DNA
gaaagggcatcttcatatactgctagtttgagtgtgaattggtacaatttgcctgcagtgtggctctaggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtga

SEQ ID NO: 6654 - DNA, 451 bp, synthetic construct
  misc_feature 1..451: note = Synthetic polypeptide
  source 1..451: mol_type = other DNA
gaaagggcatcttcatatactgctagtttgagtgtgaattggtacaatttgcctgcagtgtggctctaggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccaggcccagctgggtccagaggtgacagtggagagccgtgtaccctgagaccagcctgcagaggacagaggcaacatggaggtgcctcaaggatcagtgctgagggtcccgcccccatgccccgtcgaagaaccccctccactgcccatctgagagtgcccaagaccagcaggaggaatctcctttgcatgagagcagtatctttattgaggatgccattaagtatttcaaggaaaaagtga

SEQ ID NO: 6655 - DNA, 292 bp, synthetic construct
  misc_feature 1..292: note = Synthetic polypeptide
  source 1..292: mol_type = other DNA
gaaagggcatcttcatatactgctagtttgagtgtgaattggtacaatttgcctgcagtgtggctctaggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgact

SEQ ID NO: 6656 - DNA, 504 bp, synthetic construct
  misc_feature 1..504: note = Synthetic polypeptide
  source 1..504: mol_type = other DNA
gaaagggcatcttcatatactgctagtttgagtgtgaattggtacaatttgcctgcagtgtggctctaggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgc

SEQ ID NO: 6657 - DNA, 449 bp, synthetic construct
  misc_feature 1..449: note = Synthetic polypeptide
  source 1..449: mol_type = other DNA
gaaagggcatcttcatatactgctagtttgagtgtgaattggtacaatttgcctgcagtgtggctctaggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccaggcccagctgggtccagaggtgacagtggagagccgtgtaccctgagaccagcctgcagaggacagaggcaacatggaggtgcctcaaggatcagtgctgagggtcccgcccccatgccccgtcgaagaaccccctccactgcccatctgagagtgcccaagaccagcaggaggaatctcctttgcatgagagcagtatctttattgaggatgccattaagtatttcaaggaaaaagt

SEQ ID NO: 6658 - DNA, 454 bp, synthetic construct
  misc_feature 1..454: note = Synthetic polypeptide
  source 1..454: mol_type = other DNA
gaaagggcatcttcatatactgctagtttgagtgtgaattggtacaatttgcctgcagtgtggctctaggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccaggcccagctgggtccagaggtgacagtggagagccgtgtaccctgagaccagcctgcagaggacagaggcaacatggaggtgcctcaaggatcagtgctgagggtcccgcccccatgccccgtcgaagaaccccctccactgcccatctgagagtgcccaagaccagcaggaggaatctcctttgcatggtagttgtactcaatgctgtggagtttgagacattatttttaaactttaaatag

SEQ ID NO: 6659 - DNA, 3701 bp, synthetic construct
  misc_feature 1..3701: note = Synthetic polypeptide
  source 1..3701: mol_type = other DNA
ggccgggtgtggtggctcatgcctataatcccaacactttgggaggccgaggcgggtggatcacctgaagtcaggagtttgagaccaccttggccaacacggtgaaacacctgtaatcccagctactcgggaggctgaggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaaggcattgtgacccctgagatgttcaagaagatgtccaactcagagatcatccagcacctaacagagcagtttaatgaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaaggggtgctgacggacgcggattgtgagagcgtctacccagttgtgtatgcctctcatcgaggcctggcctctgccgcaggcgaatttctgtactggaaactcttctaccctgagtgcgagataagaatgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacagtcgtccttcctagatgaggatgaggtatataatctggcagccactctgaaacgcctctctgccttctacaacactcatgacctgactcgctgggagctctatgagccatgttgccaactcctgcagaaggctgtggacacaggagaggttcctcaccaggttatcctgccagccttgactcttgtctatttttccattctctggacactaacccacatttctaaatcagatgcttcccagaagcagctgtcgagtttgagggacagaatggtggccttctgtgaactctgccagagttgcctctcagatgtggatactgagatccaggagcaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgattcccaggaggatcatttacagatagagcggctacaccagcggcgccgcctcctagccgggttctgcaagctgttgctttatggggtgctggagatggatgcagcctcagatgttttcaaacactacaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttactgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctga

SEQ ID NO: 6660 - DNA, 3527 bp, synthetic construct
  misc_feature 1..3527: note = Synthetic polypeptide
  source 1..3527: mol_type = other DNA
ggccgggtgtggtggctcatgcctataatcccaacactttgggaggccgaggcgggtggatcacctgaagtcaggagtttgagaccaccttggccaacacggtgaaacacctgtaatcccagctactcgggaggctgaggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaaggggtgctgacggacgcggattgtgagagcgtctacccagttgtgtatgcctctcatcgaggcctggcctctgccgcaggcgaatttctgtactggaaactcttctaccctgagtgcgagataagaatgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacagtcgtccttcctagatgaggatgaggtatataatctggcagccactctgaaacgcctctctgccttctacaacactcatgacctgactcgctgggagctctatgagccatgttgccaactcctgcagaaggctgtggacacaggagaggttcctcaccaggttatcctgccagccttgactcttgtctatttttccattctctggacactaacccacatttctaaatcagatgcttcccagaagcagctgtcgagtttgagggacagaatggtggccttctgtgaactctgccagagttgcctctcagatgtggatactgagatccaggagcaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgattcccaggaggatcatttacagatagagcggctacaccagcggcgccgcctcctagccgggttctgcaagctgttgctttatggggtgctggagatggatgcagcctcagatgttttcaaacactacaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttactgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctga

SEQ ID NO: 6661 - DNA, 457 bp, synthetic construct
  misc_feature 1..457: note = Synthetic polypeptide
  source 1..457: mol_type = other DNA
ggccgggtgtggtggctcatgcctataatcccaacactttgggaggccgaggcgggtggatcacctgaagtcaggagtttgagaccaccttggccaacacggtgaaacacctgtaatcccagctactcgggaggctgaggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaagg

SEQ ID NO: 6662 - DNA, 359 bp, synthetic construct
  misc_feature 1..359: note = Synthetic polypeptide
  source 1..359: mol_type = other DNA
ggccgggtgtggtggctcatgcctataatcccaacactttgggaggccgaggcgggtggatcacctgaagtcaggagtttgagaccaccttggccaacacggtgaaacacctgtaatcccagctactcgggaggctgaggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcag

SEQ ID NO: 6663 - DNA, 588 bp, synthetic construct
  misc_feature 1..588: note = Synthetic polypeptide
  source 1..588: mol_type = other DNA
ggccgggtgtggtggctcatgcctataatcccaacactttgggaggccgaggcgggtggatcacctgaagtcaggagtttgagaccaccttggccaacacggtgaaacacctgtaatcccagctactcgggaggctgaggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctgg

SEQ ID NO: 6664 - DNA, 946 bp, synthetic construct
  misc_feature 1..946: note = Synthetic polypeptide
  source 1..946: mol_type = other DNA
ggctgagcatgggagctcacacctgtaatcctggcactgttaaagattgaggcaggcggatcacttgaggtcaggagttgaagaccagcctggccaacgtgatgaaactctgtctctactaaaaatacaaaaattagccaggagtggcaggcgcctgtaatcccagctactctggaggctgaggcaggagaattgcttgaagccaggaggcggacattacagtaagatcagcaatgtcttatttttcattttaccgcccatctgcatgtgcttgtttcgtcagtatgcaacatgcttcaacagtggcatctacttaatctggactcttttggttgtagtgggaattggatccgtctacttccatgcaacccttagtttcttgggtcagatgcttgatgaacttgcagtcctttgggttctgatgtgtgctttggccatgtggttccccagaaggtatctaccaaagatctttcggaatgaccggggtaggttcaaggtggtggtcagtgtcctgtctgcggttacgacgtgcctggcatttgtcaagcctgccatcaacaacatctctctgatgaccctgggagttccttgcactgcactgctcatcgcagagctaaagaggtgtgacaacatgcgtgtgtttaagctgggcctcttctcgggcctctggtggaccctggccctgttctgctggatcagtgaccgagctttctgcgagctgctgtcatccttcaacttcccctacctgcactgcatgtggcacatcctcatctgccttgctgcctacctgggctgtgtatgctttgcctactttgatgctgcctcagagattcctgagcaaggccctgtcatcaagttctggcccaatgagaaatgggccttcattggtgtcccctatgtgtccctcctgtgtgccaacaagaaatcatcagtcaagatcacgtga

SEQ ID NO: 6665 - DNA, 767 bp, synthetic construct
  misc_feature 1..767: note = Synthetic polypeptide
  source 1..767: mol_type = other DNA
tgccctgaaatcttaattctgttttgtgaggtctgatggatcagtggagcatctacggggcttggagcctctgctcaggcacagtcctgtctcccagcctccctgcctccctggcacagattctctgctgcctacttctgtgctccctggagcctcagtgcaaggcctcccccatctctgtcactgtcctgagatgctgcagcactctgcccccagcaggagcctgggcatggggagggctggggttgggcacatgtgccactcagcatcttcatggcatcagtcgtccctgccctgcaagggcatttggtgggcaacttgggagggatgatgagcaggtcaagaccatctccatcaaccaggtgctctccaataaagacctcatcaactacaataagtttgtgcagagctgcatcgactggaaccgtgaggtgctgaagcgggagctgggcctggcagagtgtgacatcattgacatcccacagctcttcaagaccgagaggaaaaaagcaacggccttcttccctgacttggtgaacatgctggtgctggggaagcacctgggcatccccaagccctttgggcccatcatcaatggctgctgctgcctggaggagaaggtgcggtccctgctggagccgctgggcctccactgcaccttcattgatgacttcactccataccacatgctgcatggggaggtgcactgtggcaccaatgtgtgcagaaagcccttctctttcaagtggtggaacatggtgccctga

SEQ ID NO: 6666 - DNA, 427 bp, synthetic construct
  misc_feature 1..427: note = Synthetic polypeptide
  source 1..427: mol_type = other DNA
gaaacctggctctgccacttcccaagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaagatagacgaggcagtggccgtgctgcaggcacaccaggctatggagcagccgaaggcgtacatgcactga

SEQ ID NO: 6667 - DNA, 370 bp, synthetic construct
  misc_feature 1..370: note = Synthetic polypeptide
  source 1..370: mol_type = other DNA
gaaacctggctctgccacttcccaagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaagatttcagcttaa

SEQ ID NO: 6668 - DNA, 436 bp, synthetic construct
  misc_feature 1..436: note = Synthetic polypeptide
  source 1..436: mol_type = other DNA
gaaacctggctctgccacttcccaagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaagaaaaggaaatcctcgcttccatggctgccaaaaggacagtgtttctggctctcagccctaaggccctgcaaactctaa

SEQ ID NO: 6669 - DNA, 445 bp, synthetic construct
  misc_feature 1..445: note = Synthetic polypeptide
  source 1..445: mol_type = other DNA
gaaacctggctctgccacttcccaagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggcacctgttatcttgtcttaaaacgctggtcagactggatggtcctgagctttcttccactgctgctgtcctgtgactttgaggggagcgtctctacccccttatccatgatgtccacacccagctggctggcaagatcacgggcatgctgctggagattgacaactcagagctgttgctcatgctggagtctccagaatccctccatgccaagatag

SEQ ID NO: 6670 - DNA, 433 bp, synthetic construct
  misc_feature 1..433: note = Synthetic polypeptide
  source 1..433: mol_type = other DNA
gaaacctggctctgccacttcccaagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaaggcccagagacggaaagtacaaagactagtaaaatacatccttgcccttaaggagctaagtacccaaaacctgtaa

SEQ ID NO: 6671 - DNA, 163 bp, synthetic construct
  misc_feature 1..163: note = Synthetic polypeptide
  source 1..163: mol_type = other DNA
ggcctgagttttctcacgtgtagaatggagccccaacccccgcctgaccttctgcgtcaaaacctacgaacgccttttctacatggtggctccgagccccgaagccatgcgcatttggatggacgtcatcgtgaccgccgctgacgaaaaccacgccccctga

SEQ ID NO: 6672 - DNA, 1389 bp, synthetic construct; identical to SEQ ID NO: 863
  misc_feature 1..1389: note = Synthetic polypeptide
  source 1..1389: mol_type = other DNA

SEQ ID NO: 6673 - DNA, 1211 bp, synthetic construct; identical to SEQ ID NO: 526
  misc_feature 1..1211: note = Synthetic polypeptide
  source 1..1211: mol_type = other DNA

SEQ ID NO: 6674 - DNA, 1133 bp, synthetic construct; identical to SEQ ID NO: 527
  misc_feature 1..1133: note = Synthetic polypeptide
  source 1..1133: mol_type = other DNA

SEQ ID NO: 6675 - DNA, 841 bp, synthetic construct; identical to SEQ ID NO: 529
  misc_feature 1..841: note = Synthetic polypeptide
  source 1..841: mol_type = other DNA

SEQ ID NO: 6676 - DNA, 659 bp, synthetic construct; identical to SEQ ID NO: 530
  misc_feature 1..659: note = Synthetic polypeptide
  source 1..659: mol_type = other DNA

SEQ ID NO: 6677 - DNA, 2535 bp, synthetic construct
  misc_feature 1..2535: note = Synthetic polypeptide
  source 1..2535: mol_type = other DNA
ctgtaagacctgcactttgggaggccaaggcgggtggctcacctgaggtcagtagttcaagaccagcctggccaacatggtgaaatcccatctctactaaaaatacaaaaaaatagctggatgtggtggtgggcgcctgtcatcccagctactcgggaggctgaggcaggagaatcgcatgaacccaggaggcagaggttgcagtgagccaagatcacaccattgcactccagcctgggcgaagaggagaccccgaaagaaagcctcacagaggctgaagtggccacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgcccccgggccaagaattcccaccagccatggtggatgctgggaagggcaagacagcagaggccagaaagacgtggctggaggagcaaggcatgatcctgaagcagacgttctgcgaggttcccgacctggaccgaattatccccgtgctgctggagcacggcctggaacgtctcccggagcactgcaagctgagcccagggattcccctgaaaccaatgttggcccatcccacccggggcatcagcgaggtcctgaaacgctttgaggaggcagctttcacctgcgaatacaaatatgacgggcagagggcacagatccacgccctggaaggcggggaggtgaagatcttcagcaggaatcaggaagacaacactgggaagtacccggacatcatcagccgcatccccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaagcttggaactggcttcagtgatgaggagctggaggagcatcaccagagcctcaaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaa

SEQ ID NO: 6678 - DNA, 2181 bp, synthetic construct
  misc_feature 1..2181: note = Synthetic polypeptide
  source 1..2181: mol_type = other DNA
ctgtaagacctgcactttgggaggccaaggcgggtggctcacctgaggtcagtagttcaagaccagcctggccaacatggtgaaatcccatctctactaaaaatacaaaaaaatagctggatgtggtggtgggcgcctgtcatcccagctactcgggaggctgaggcaggagaatcgcatgaacccaggaggcagaggttgcagtgagccaagatcacaccattgcactccagcctgggcgaagaggagaccccgaaagaaagcctcacagaggctgaagtggccacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgcccccgggccaagaattcccaccagccatggtggatgctgggaagggcaagacagcagaggccagaaagacgtggctggaggagcaaggcatgatcctgaagcagacgttctgcgaggttcccgacctggaccgaattatccccgtgctgctggagcacggcctggaacgtctcccggagcactgcaagctgagcccagggattcccctgaaaccaatgttggcccatcccacccggggcatcagcgaggtcctgaaacgctttgaggaggcagctttcacctgcgaatacaaatatgacgggcagagggcacagatccacgccctggaaggcggggaggtgaagatcttcagcaggaatcaggaagacaacactgggaagtacccggacatcatcagccgcatccccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaaggtcctggggaactggggctga

SEQ ID NO: 6679 - DNA, 1119 bp, synthetic construct
  misc_feature 1..1119: note = Synthetic polypeptide
  source 1..1119: mol_type = other DNA
ctgtaagacctgcactttgggaggccaaggcgggtggctcacctgaggtcagtagttcaagaccagcctggccaacatggtgaaatcccatctctactaaaaatacaaaaaaatagctggatgtggtggtgggcgcctgtcatcccagctactcgggaggctgaggcaggagaatcgcatgaacccaggaggcagaggttgcagtgagccaagatcacaccattgcactccagcctgggcgaagaggagaccccgaaagaaagcctcacagaggctgaagtggccacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggccgcgagagaagggagacacgcagccacaactgtcaccctcgacacccccacccgcgctctcccctgaaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatag

SEQ ID NO: 6680 - DNA, 1861 bp, synthetic construct
  misc_feature 1..1861: note = Synthetic polypeptide
  source 1..1861: mol_type = other DNA
tgaaaccaccttgctaaggttatgatggttagagaaatccaacacagctgactttatcttgcttctgaccccagaagctgactatctgctcattcctgggtgtaggtcaagctaactaaaaaggagtttagtttacagtttaactttaaagcaaggatgataatagtcccttcctgaaactggtccccttcttgcttgggaactgaaactgcatttgtaaaactaatgaaagtcaataagattagaattatgataagggcctgaattctgctaagtaataagcacagtgaagaagagataaccagccattgttccctagcttggttactgctggaggtcacaagatttgagataacatcaccactgtaaaccctaagatgggtttttgagatatttttcagacctttgcattctggtaaactgactgatgccatctggaccatgactcataccaaggaacagactcaactcgtcctgtgacccccacctagaaactgactcagcacgtgaagacagttccaacactccagtgatttcatctccaaccaatcagtagcatacattccctggccctcagcttgccaaattatccttaaaaaccctgggctccaagctttcgaggaggtggatttgagagatacctcccctccttctgctcagctgccttgcagtaattaaactctttctctgctgcaacacccctactgttctccgtgtattggcttttctgggcagcaggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaa

SEQ ID NO: 6681 - DNA, 1123 bp, synthetic construct
  misc_feature 1..1123: note = Synthetic polypeptide
  source 1..1123: mol_type = other DNA
tgaaaccaccttgctaaggttatgatggttagagaaatccaacacagctgactttatcttgcttctgaccccagaagctgactatctgctcattcctgggtgtaggtcaagctaactaaaaaggagtttagtttacagtttaactttaaagcaaggatgataatagtcccttcctgaaactggtccccttcttgcttgggaactgaaactgcatttgtaaaactaatgaaagtcaataagattagaattatgataagggcctgaattctgctaagtaataagcacagtgaagaagagataaccagccattgttccctagcttggttactgctggaggtcacaagatttgagataacatcaccactgtaaaccctaagatgggtttttgagatatttttcagacctttgcattctggtaaactgactgatgccatctggaccatgactcataccaaggaacagactcaactcgtcctgtgacccccacctagaaactgactcagcacgtgaagacagttccaacactccagtgatttcatctccaaccaatcagtagcatacattccctggccctcagcttgccaaattatccttaaaaaccctgggctccaagctttcgaggaggtggatttgagagatacctcccctccttctgctcagctgccttgcagtaattaaactctttctctgctgcaacacccctactgttctccgtgtattggcttttctgggcagcaggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaacccataggcatgaaatga

SEQ ID NO: 6682 - DNA, 774 bp, synthetic construct
  misc_feature 1..774: note = Synthetic polypeptide
  source 1..774: mol_type = other DNA
tttcttggttccctgaccggcaagcgaggtgagtaatggacggtccaggcagcttcttaagcggctttagcctgccctgtggaacatccctgcgggggactccaaccagccggagcgacgcggatcctgagagcgctcccgggtaggcatttgccccggtgggatgcctcgccagagccgtgtgtggcaggcccccgtggaggatcaacgcagtggctgaacaccgggaaggaactggcacttggcacttggagtccggacgtctcaaactcggctcaacagtaccagcagcagcgtcgaaaatttgcagctgccttcttggcattcattttcatactggcagctgtggatactgctgaagcagggaagaaagagaaaccagaaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatcccctgcaactggaagaagcaatttggcgcggagtgcaaataccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaacctcaagcagaatctaagaagaagaaaaaggaaggcaagaaacaggagaagatgctggattaa

SEQ ID NO: 6683 - DNA, 768 bp, synthetic construct
  misc_feature 1..768: note = Synthetic polypeptide
  source 1..768: mol_type = other DNA
tttcttggttccctgaccggcaagcgaggtgagtaatggacggtccaggcagcttcttaagcggctttagcctgccctgtggaacatccctgcgggggactccaaccagccggagcgacgcggatcctgagagcgctcccgggtaggcatttgccccggtgggatgcctcgccagagccgtgtgtggcaggcccccgtggaggatcaacgcagtggctgaacaccgggaaggaactggcacttggcacttggagtccggacgtctcaaactcggctcaacagtaccagcagcagcgtcgaaaatttgcagctgccttcttggcattcattttcatactggcagctgtggatactgctgaagcagggaagaaagagaaaccagaaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatcccctgcaactggaagaagcaatttggcgcggagtgcaaataccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaacctcaagagaagggaaaatggagacacaggagtggggagagtttgagaagatggtag

SEQ ID NO: 6684 - DNA, 1765 bp, synthetic construct
  misc_feature 1..1765: note = Synthetic polypeptide
  source 1..1765: mol_type = other DNA
aggcataccttgtcttattgcacttagctttattgtattttatggatactttgctttttataaattgaaggtttttggcaaccttgccccaagcaagtctgtcagtaccatttttccaacaacatgtgttcactttgtgtctgtgtgtcaaattttggtaattcttacagtatttcaaacttcttcatgatttattgtgtccgttagtgatctttgatgttgctattgtaattgttgggcgggggggcaccatgaaatgtgcccataaaagttactgaatttatttgataaatgaaatgctgtgtgtgttctgaccactccacccaccagccgttccccatctctctccctctcagacttccctatttccttagacacaacaatattgaaactaggccagttaataaccgtattatggcctctcggtgtccaagtgaaagaaagtgtcccatgtctgttacttaaaatccaaagctagaaatgattgagcttagtgaagaaggcatgtgaaaagccaaataggccaaaagctaggcctcaacaccaaatattagtcaagttatgaaagcaaaggaaaattcttgaaggaaattaaaagtgctactccagtgaacgcacaaatgataagaaagcagaacatccttattgctgatatggagaaagtttcagtggtctggatagaatatcaaaccagccacaacattcttttaagccaaaccataatccagaccaagatcctaactcttgaattctgtgaaggctgagacaggtgaggaagctacaaaagaaaagtttgaagctagcagaggttggttcatgaggtttaaggaaagaagccatctccataacagaaaagtacaaggtgaagcagcagatgctgttgtagaagctgcagcaagttatccggaagacctagctaagatcattgacggtgggtacactcaacaacagattttcaatgtagacggaatagccttctattggaagaaagtgacatctggaacttgcacagctagagagaagtcaatgcctggtttccaagatgcaaagatcagagtgattcccttgttagggactaatgcagctggtgattttacattgaagccaaagctcatttagcattctgaaaattgtagggcccttaagaaggtggggctaaatctactctgcctgtgctctgtaaatagaacaacaaagtctggatgacaacacatctgtttacagcatggtttactgaatattttttaagccccccattaagaggtactgttcagaaaaatagattcctttcaaaatattacagtgcacctcattaccctaaagctcagatggagatgtttcatgcctgcaacatccaatcttcggcttatggatcaaggagtaattttgactttcaagtcttattacttaagaaatacattttataaagctatagctgccctggatagtggttcctttgatggatctggacaaagtaaattgaaaacctggaaaggattcaccattctacacgcccttaagaacatttgtgattcatgggaggaggttaaactatgaacataaagaggagtttggaagaaattgattccaacccttcagccctcatggatgactttgagggattgaggacttccatggagggagtaactgcagatgtggaggaaatgagcatagcggcctgaccacaggggtggccttcgggcatcacgccaagttcatcgcttcaacaggcatggacagaagcctcaagttctacagcctgtag

SEQ ID NO: 6685 - DNA, 1257 bp, synthetic construct; identical to SEQ ID NO: 625
  misc_feature 1..1257: note = Synthetic polypeptide
  source 1..1257: mol_type = other DNA

SEQ ID NO: 6686 - DNA, 1215 bp, synthetic construct; identical to SEQ ID NO: 626
  misc_feature 1..1215: note = Synthetic polypeptide
  source 1..1215: mol_type = other DNA

SEQ ID NO: 6687 - DNA, 507 bp, synthetic construct; identical to SEQ ID NO: 628
  misc_feature 1..507: note = Synthetic polypeptide
  source 1..507: mol_type = other DNA

SEQ ID NO: 6688 - DNA, 313 bp, synthetic construct; identical to SEQ ID NO: 629
  misc_feature 1..313: note = Synthetic polypeptide
  source 1..313: mol_type = other DNA

SEQ ID NO: 6689 - DNA, 291 bp, synthetic construct; identical to SEQ ID NO: 630
  misc_feature 1..291: note = Synthetic polypeptide
  source 1..291: mol_type = other DNA

SEQ ID NO: 6690 - DNA, 1224 bp, synthetic construct
  misc_feature 1..1224: note = Synthetic polypeptide
  source 1..1224: mol_type = other DNA
catggctcctggaaggactaaatgaagtcatgagtataaagtgctcctgcatggccagcagccggatgcccgggcccactgggcgggccagtggccgcctgcgggatgagcagactgctgggggggacgctggagcgcgtctgcaaggctgtgctccttctctgcctgctgcacttcctcgtggccgtcatcctctactttgacgtctacgcccagcacctggccttcttcagccgcttcagtgcccgaggccctgcccatgccctccacccagctgctagcagcagcagcagcagcagcaactgctcccggcccaacgccaccgcctctagctccgggctccctgaggtccccagtgccctgcccggtcccacggctcccacgctgccaccctgtcctgactcgccacctggtcttgtgggcagactgctgatcgagttcacctcacccatgcccctggagcgggtgcagagggagaacccaggcgtgctcatgggcggccgatacacaccgcccgactgcaccccagcccagacggtggcggtcatcatcccctttagacaccgggaacaccacctgcgctactggctccactatctacaccccatcttgaggcggcagcggctgcgctacggcgtctatgtcatcaaccagcatggtgaggacaccttcaaccgggccaagctgcttaacgtgggcttcctagaggcgctgaaggaggatgccgcctatgactgcttcatcttcagcgatgtggacctggtccccatggatgaccgcaacctataccgctgcggcgaccaaccccgccactttgccattgccatggacaagtttggcttccggcttccctatgctggctactttggaggtgtgtcaggcctgagtaaggctcagtttctgagaatcaatggcttccccaatgagtactggggctggggtggcgaggatgatgacatcttcaaccggatctccctgactgggatgaagatctcacgcccagacatccgaatcggccgctaccgcatgatcaagcacgaccgcgacaagcataacgaacctaaccctcagaggtttaccaagattcaaaacacgaagctgaccatgaagcgggacggcattgggtcagtgcggtaccaggtcttggaggtgtctcggcaaccactcttcaccaatatcacagtggacattgggcggcctccgtcgtggccccctcggggctga

SEQ ID NO: 6691 - DNA, 1731 bp, synthetic construct
  misc_feature 1..1731: note = Synthetic polypeptide
  source 1..1731: mol_type = other DNA
gccaacatggcaaaaacctgtctcgagtaaaattggaaaaatcagccaggcatggtgatgcaccactcctgtaatcccagctacttgtgtacctgaggcaggaggatcgcttgaacctgggaggcagaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccatcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttaccgaacctaaaactgagaagccagagagaccctctcgggagcgagatcgagaaaaagttactcaaagatctgtttctccatcacctgtgcctttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatga

SEQ ID NO: 6692 - DNA, 2019 bp, synthetic construct
  misc_feature 1..2019: note = Synthetic polypeptide
  source 1..2019: mol_type = other DNA
gccaacatggcaaaaacctgtctcgagtaaaattggaaaaatcagccaggcatggtgatgcaccactcctgtaatcccagctacttgtgtacctgaggcaggaggatcgcttgaacctgggaggcagaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccatcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttaccgaacctaaaactgagaagccagagagaccctctcgggagcgagatcgagaaaaagttactcaaagatctgtttctccatcacctgtgcctctttctagtaactatattgctcagatttccaacggccagcaactcatgagccagccacagctacataggcgctctaactcttgcagcagcatttctgtagcttcctgtatttcggaatgggagcagaaaattcctacgtacaacacacctctcaaagtcacatctattgcaaggcgtaggcagcaggagccaggacaaagcaaaacttgtatcgtgtcagacagaaggcgagggatgtactggactgaaggcagggaggtggttcctacattcagaaatgagatagaaatagaagaggatcattgcggcaggaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatga

SEQ ID NO: 6693 - DNA, 2043 bp, synthetic construct
  misc_feature 1..2043: note = Synthetic polypeptide
  source 1..2043: mol_type = other DNA
gccaacatggcaaaaacctgtctcgagtaaaattggaaaaatcagccaggcatggtgatgcaccactcctgtaatcccagctacttgtgtacctgaggcaggaggatcgcttgaacctgggaggcagaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccatcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttaccgaacctaaaactgagaagccagagagaccctctcgggagcgagatcgagaaaaagttactcaaagatctgtttctccatcacctgtgcctctttctagtaactatattgctcagatttccaacggccagcaactcatgagccagccacagctacataggcgctctaactcttgcagcagcatttctgtagcttcctgtatttcggaatgggagcagaaaattcctacgtacaacacacctctcaaagtcacatctattgcaaggcgtaggcagcaggagccaggacaaagcaaaacttgtatcgtgtcagacagaaggcgagggatgtactggactgaaggcagggaggtggttcctacattcagaaatgagatagaaatagaagaggatcattgcggcaggttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatga

SEQ ID NO: 6694 - DNA, 554 bp, synthetic construct
  misc_feature 1..554: note = Synthetic polypeptide
  source 1..554: mol_type = other DNA
gccaacatggcaaaaacctgtctcgagtaaaattggaaaaatcagccaggcatggtgatgcaccactcctgtaatcccagctacttgtgtacctgaggcaggaggatcgcttgaacctgggaggcagaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttggtaattttaatatttgcggaagtgactcaagaagttgaagtagcaagacctgtagacaaggcaatatgtggtttaacgcctgggaggagatacagaaaccagcctcgaggtccagttggaaa

SEQ ID NO: 6695 - DNA, 1024 bp, synthetic construct
  misc_feature 1..1024: note = Synthetic polypeptide
  source 1..1024: mol_type = other DNA
gtgaaaagagccaggacactggaggccagcagatagcagtgaccttcgggagaaaaactgggaagcaatggaagcattggcatcaactgaaaaaatgctgcaggacaaagtgaacaagacttccaaggaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagctgaaagatctgttgactgaattgcagaaaaaacttgatgattcatattctgaagcagtaagacagaatgaagagctaaatttgttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtga

SEQ ID NO: 6696 - DNA, 940 bp, synthetic construct
  misc_feature 1..940: note = Synthetic polypeptide
  source 1..940: mol_type = other DNA
gtgaaaagagccaggacactggaggccagcagatagcagtgaccttcgggagaaaaactgggaagcaatggaagcattggcatcaactgaaaaaatgctgcaggacaaagtgaacaagacttccaaggaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtga

SEQ ID NO: 6697 - DNA, 274 bp, synthetic construct
  misc_feature 1..274: note = Synthetic polypeptide
  source 1..274: mol_type = other DNA
ggtcgggcgcggtggctcacgtctgtaatcccagcactttggaaggccgaggctacggaaaaacctgcgagccctggtggttgtccatgctacatggtatgtgaaagcatttctggcactgcttcggcccttcatcagttccaaattcacacgaaaaatccgttttctggacagcctgggggagctggcccaactcatatccctggatcaagtccacatccctgaagctgtcagacagctggaccgggatctccatggctcaggagggacatag

SEQ ID NO: 6698 - DNA, 1327 bp, synthetic construct
  misc_feature 1..1327: note = Synthetic polypeptide
  source 1..1327: mol_type = other DNA
cctggttctgctacctaccagctgagttactttggtcaagctcttggacttctgaggctgtttcctaatttcaaaattaaaagcatattggcagaggaagagccctggcattccagcaggagctaacaggaaaaagaaagtcaatggcagtagccctgacacagccacttctggtggttaccactcacctggggattcagcaacaggtatctacggggagggccgtgcatcctctactaccctgcaggatctggagagccagtaccaagaactagcagtagccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccacagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctgtgtgaacaggaggagaggctgtgtgaacaggaggagaggctacgtgaacaggaggagaggctgtgtgaacaggagaagctgccagggcaggagaggctgctggaagaggtggagaagctgttaaaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggttgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcggccaccacatgtcctcatgcccagggtcttccggcaggtggagctgaagagccaagaggctccgagtctgcagcagcagccagaccagtacctggagccccagtcccacaaggagcttggatgtgcggacaagcagggtggactccccaggagcacccaggcttgagtggagaagctgttggtacaggagaggcggcaggaggagcaggagaggctgcatgccattcttttcgggctgccgagaacagggagctaaacatcaccatcatctaa

SEQ ID NO: 6699 - DNA, 1291 bp, synthetic construct
  misc_feature 1..1291: note = Synthetic polypeptide
  source 1..1291: mol_type = other DNA
cctggttctgctacctaccagctgagttactttggtcaagctcttggacttctgaggctgtttcctaatttcaaaattaaaagcatattggcagaggaagagccctggcattccagcaggagctaacaggaaaaagaaagtcaatggcagtagccctgacacagccacttctggtggttaccactcacctggggattcagcaacaggtatctacggggagggccgtgcatcctctactaccctgcaggatctggagagccagtaccaagaactagcagtagccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccacagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctgtgtgaacaggaggagaggctgtgtgaacaggaggagaggctacgtgaacaggaggagaggctgtgtgaacaggagaagctgccagggcaggagaggctgctggaagaggtggagaagctgttaaaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggttgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcgggtggagctgaagagccaagaggctccgagtctgcagcagcagccagaccagtacctggagccccagtcccacaaggagcttggatgtgcggacaagcagggtggactccccaggagcacccaggcttgagtggagaagctgttggtacaggagaggcggcaggaggagcaggagaggctgcatgccattcttttcgggctgccgagaacagggagctaaacatcaccatcatctaa

SEQ ID NO: 6700 - DNA, 1273 bp, synthetic construct
  misc_feature 1..1273: note = Synthetic polypeptide
  source 1..1273: mol_type = other DNA
taagcaaaaagaaaagtctggaggcatcacattacctgatttcaaactatactgtaaggccatagtcaccaaaaacatcatggtactggcataaaaacaagcacatagatcaatggaacagaatagagaacccagaaattaacccaaatacttacagccaactgatcttcgacaaagcaaacaaaaacataaagtggggaaaggacaccctattcaacaaatggtgctgccaatgtaggagaatgaaactggatcctcatctcccaccttatacaaaaatcaactcaagatggattaaggacttacttacatctacgacctgaaactataaaaattgtagaagacaacttaggaaaaacccttctagacattggcttaggcaaggatttcatgaccaagaacccaaaagcaaatgcaataaagacaaagataaatagctgagacttaattaaactaaagagcttttacacagcaaaaggaacagtcagcaaagtgaacagacaacccacagagtgggagaagatctttacaatctgtacatctgacaaaggactaatacccagaatctataacgaactcaatcaaatcagcaagaaaaaaaacaatcacatcaaaaagtgggctaaggacatgaatagacaattctaaaaagaagacatacaaatggccaaaaaatatatgaaaaaatgctcaacatcactaatgatcagagaaatgcaaatcaaaaccacaatgcagtaccaccttactcctgcaagaatggccgtaatcaaaaaaatcaaaaaacagtagatgtttggcatggatgtggtgaagagggaacacttctacactgcaggtgggaatgtaaactagtacagccattatggaaaacggtgtggagattccttaaagaactaaaagtagaactaccatttgatccagcaatcccactactgggtatctacccagaggaaaagaagtcattatatgaaaaagatacttgtacacatatatttatagcagcacaacttgcaactgtgaaatcatgggaccaacccaaatgtccatcagtcaacgagtggataaagaaactgtggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttag

SEQ ID NO: 6701 - DNA, 1357 bp, synthetic construct
  misc_feature 1..1357: note = Synthetic polypeptide
  source 1..1357: mol_type = other DNA
taagcaaaaagaaaagtctggaggcatcacattacctgatttcaaactatactgtaaggccatagtcaccaaaaacatcatggtactggcataaaaacaagcacatagatcaatggaacagaatagagaacccagaaattaacccaaatacttacagccaactgatcttcgacaaagcaaacaaaaacataaagtggggaaaggacaccctattcaacaaatggtgctgccaatgtaggagaatgaaactggatcctcatctcccaccttatacaaaaatcaactcaagatggattaaggacttacttacatctacgacctgaaactataaaaattgtagaagacaacttaggaaaaacccttctagacattggcttaggcaaggatttcatgaccaagaacccaaaagcaaatgcaataaagacaaagataaatagctgagacttaattaaactaaagagcttttacacagcaaaaggaacagtcagcaaagtgaacagacaacccacagagtgggagaagatctttacaatctgtacatctgacaaaggactaatacccagaatctataacgaactcaatcaaatcagcaagaaaaaaaacaatcacatcaaaaagtgggctaaggacatgaatagacaattctaaaaagaagacatacaaatggccaaaaaatatatgaaaaaatgctcaacatcactaatgatcagagaaatgcaaatcaaaaccacaatgcagtaccaccttactcctgcaagaatggccgtaatcaaaaaaatcaaaaaacagtagatgtttggcatggatgtggtgaagagggaacacttctacactgcaggtgggaatgtaaactagtacagccattatggaaaacggtgtggagattccttaaagaactaaaagtagaactaccatttgatccagcaatcccactactgggtatctacccagaggaaaagaagtcattatatgaaaaagatacttgtacacatatatttatagcagcacaacttgcaactgtgaaatcatgggaccaacccaaatgtccatcagtcaacgagtggataaagaaactgtggtttaccgacaagactgtgaaactttcgggatggtggtgaaaatgctgattgaaaaagatccttcattagaaaagtctatacagtttgcattgaggcagaatttacatgaaatagagtctgcaggacagacttggcagcaggtaccccctgtgaggaacactgaaatggatcacgacggaacccccgaaaacgaaggcgaagagactgcgcagtcaaaccttgaaacagccctcattaagtctactctcgagccggccctgtgtgccttttttctttga

SEQ ID NO: 6702 - DNA, 1546 bp, synthetic construct
  misc_feature 1..1546: note = Synthetic polypeptide
  source 1..1546: mol_type = other DNA
taagcaaaaagaaaagtctggaggcatcacattacctgatttcaaactatactgtaaggccatagtcaccaaaaacatcatggtactggcataaaaacaagcacatagatcaatggaacagaatagagaacccagaaattaacccaaatacttacagccaactgatcttcgacaaagcaaacaaaaacataaagtggggaaaggacaccctattcaacaaatggtgctgccaatgtaggagaatgaaactggatcctcatctcccaccttatacaaaaatcaactcaagatggattaaggacttacttacatctacgacctgaaactataaaaattgtagaagacaacttaggaaaaacccttctagacattggcttaggcaaggatttcatgaccaagaacccaaaagcaaatgcaataaagacaaagataaatagctgagacttaattaaactaaagagcttttacacagcaaaaggaacagtcagcaaagtgaacagacaacccacagagtgggagaagatctttacaatctgtacatctgacaaaggactaatacccagaatctataacgaactcaatcaaatcagcaagaaaaaaaacaatcacatcaaaaagtgggctaaggacatgaatagacaattctaaaaagaagacatacaaatggccaaaaaatatatgaaaaaatgctcaacatcactaatgatcagagaaatgcaaatcaaaaccacaatgcagtaccaccttactcctgcaagaatggccgtaatcaaaaaaatcaaaaaacagtagatgtttggcatggatgtggtgaagagggaacacttctacactgcaggtgggaatgtaaactagtacagccattatggaaaacggtgtggagattccttaaagaactaaaagtagaactaccatttgatccagcaatcccactactgggtatctacccagaggaaaagaagtcattatatgaaaaagatacttgtacacatatatttatagcagcacaacttgcaactgtgaaatcatgggaccaacccaaatgtccatcagtcaacgagtggataaagaaactgtggtttaccgacaagactgtgaaactttcgggatggtggtgaaaatgctgattgaaaaagatccttcattagaaaagtctatacagtttgcattgaggcagaatttacatgaaatagagtctgcaggacagacttggcagcaggtaccccctgtgaggaacactgaaatggatcacgacggaacccccgaaaacgaaggcgaagagactgcgcagtcagccccgcagcccccgcaggccccgcagcccctgcagccccggaagaaacgggttcgtcggacgacacagcttcgtcggacgacaggagccccagacattacctgggggatgctgaagaagacaactcaggaggctgagaggatcctgctccgaacacagacaccattcactccagaaaatttgttccttgctatgctctctgttgtacattgcaactcacgcaaggatgtaaagccagaaaacaagcagtaa

SEQ ID NO: 6703 - DNA, 1621 bp, synthetic construct
  misc_feature 1..1621: note = Synthetic polypeptide
  source 1..1621: mol_type = other DNA
taagcaaaaagaaaagtctggaggcatcacattacctgatttcaaactatactgtaaggccatagtcaccaaaaacatcatggtactggcataaaaacaagcacatagatcaatggaacagaatagagaacccagaaattaacccaaatacttacagccaactgatcttcgacaaagcaaacaaaaacataaagtggggaaaggacaccctattcaacaaatggtgctgccaatgtaggagaatgaaactggatcctcatctcccaccttatacaaaaatcaactcaagatggattaaggacttacttacatctacgacctgaaactataaaaattgtagaagacaacttaggaaaaacccttctagacattggcttaggcaaggatttcatgaccaagaacccaaaagcaaatgcaataaagacaaagataaatagctgagacttaattaaactaaagagcttttacacagcaaaaggaacagtcagcaaagtgaacagacaacccacagagtgggagaagatctttacaatctgtacatctgacaaaggactaatacccagaatctataacgaactcaatcaaatcagcaagaaaaaaaacaatcacatcaaaaagtgggctaaggacatgaatagacaattctaaaaagaagacatacaaatggccaaaaaatatatgaaaaaatgctcaacatcactaatgatcagagaaatgcaaatcaaaaccacaatgcagtaccaccttactcctgcaagaatggccgtaatcaaaaaaatcaaaaaacagtagatgtttggcatggatgtggtgaagagggaacacttctacactgcaggtgggaatgtaaactagtacagccattatggaaaacggtgtggagattccttaaagaactaaaagtagaactaccatttgatccagcaatcccactactgggtatctacccagaggaaaagaagtcattatatgaaaaagatacttgtacacatatatttatagcagcacaacttgcaactgtgaaatcatgggaccaacccaaatgtccatcagtcaacgagtggataaagaaactgtggtttaccgacaagactgtgaaactttcgggatggtggtgaaaatgctgattgaaaaagatccttcattagaaaagtctatacagtttgcattgaggcagaatttacatgaaatagagtctgcaggacagacttggcagcaggtaccccctgtgaggaacactgaaatggatcacgacggaacccccgaaaacgaaggcgaagagactgcgcagtcacacgacgcatcaaaccataccatagtggggctaggacccaaccaagtaccagaaatgaaggaaacgaccctgcaggccccgcagcccccgcaggccccgcagcccctgcagccccggaagaaacgggttcgtcggacgacacagcttcgtcggacgacaggagccccagacattacctgggggatgctgaagaagacaactcaggaggctgagaggatcctgctccgaacacagacaccattcactccagaaaatttgttccttgctatgctctctgttgtacattgcaactcacgcaaggatgtaaagccagaaaacaagcagtaa

SEQ ID NO: 6704 - DNA, 1282 bp, synthetic construct
  misc_feature 1..1282: note = Synthetic polypeptide
  source 1..1282: mol_type = other DNA
taagcaaaaagaaaagtctggaggcatcacattacctgatttcaaactatactgtaaggccatagtcaccaaaaacatcatggtactggcataaaaacaagcacatagatcaatggaacagaatagagaacccagaaattaacccaaatacttacagccaactgatcttcgacaaagcaaacaaaaacataaagtggggaaaggacaccctattcaacaaatggtgctgccaatgtaggagaatgaaactggatcctcatctcccaccttatacaaaaatcaactcaagatggattaaggacttacttacatctacgacctgaaactataaaaattgtagaagacaacttaggaaaaacccttctagacattggcttaggcaaggatttcatgaccaagaacccaaaagcaaatgcaataaagacaaagataaatagctgagacttaattaaactaaagagcttttacacagcaaaaggaacagtcagcaaagtgaacagacaacccacagagtgggagaagatctttacaatctgtacatctgacaaaggactaatacccagaatctataacgaactcaatcaaatcagcaagaaaaaaaacaatcacatcaaaaagtgggctaaggacatgaatagacaattctaaaaagaagacatacaaatggccaaaaaatatatgaaaaaatgctcaacatcactaatgatcagagaaatgcaaatcaaaaccacaatgcagtaccaccttactcctgcaagaatggccgtaatcaaaaaaatcaaaaaacagtagatgtttggcatggatgtggtgaagagggaacacttctacactgcaggtgggaatgtaaactagtacagccattatggaaaacggtgtggagattccttaaagaactaaaagtagaactaccatttgatccagcaatcccactactgggtatctacccagaggaaaagaagtcattatatgaaaaagatacttgtacacatatatttatagcagcacaacttgcaactgtgaaatcatgggaccaacccaaatgtccatcagtcaacgagtggataaagaaactgtggtttaccgacaagactgtgaaactttcgggatggtggtgaaaatgctgattgaaaaagatccttcattagaaaagtctatacagtttgcattgaggcagaatttacatgaaatagctggcgctgatacaatacaatgtttacctggccaaagagggttcgaggggacaagctggcctcacaataagatgcacagtgttagctag

SEQ ID NO: 6705 - DNA, 1639 bp, synthetic construct
  misc_feature 1..1639: note = Synthetic polypeptide
  source 1..1639: mol_type = other DNA
taagcaaaaagaaaagtctggaggcatcacattacctgatttcaaactatactgtaaggccatagtcaccaaaaacatcatggtactggcataaaaacaagcacatagatcaatggaacagaatagagaacccagaaattaacccaaatacttacagccaactgatcttcgacaaagcaaacaaaaacataaagtggggaaaggacaccctattcaacaaatggtgctgccaatgtaggagaatgaaactggatcctcatctcccaccttatacaaaaatcaactcaagatggattaaggacttacttacatctacgacctgaaactataaaaattgtagaagacaacttaggaaaaacccttctagacattggcttaggcaaggatttcatgaccaagaacccaaaagcaaatgcaataaagacaaagataaatagctgagacttaattaaactaaagagcttttacacagcaaaaggaacagtcagcaaagtgaacagacaacccacagagtgggagaagatctttacaatctgtacatctgacaaaggactaatacccagaatctataacgaactcaatcaaatcagcaagaaaaaaaacaatcacatcaaaaagtgggctaaggacatgaatagacaattctaaaaagaagacatacaaatggccaaaaaatatatgaaaaaatgctcaacatcactaatgatcagagaaatgcaaatcaaaaccacaatgcagtaccaccttactcctgcaagaatggccgtaatcaaaaaaatcaaaaaacagtagatgtttggcatggatgtggtgaagagggaacacttctacactgcaggtgggaatgtaaactagtacagccattatggaaaacggtgtggagattccttaaagaactaaaagtagaactaccatttgatccagcaatcccactactgggtatctacccagaggaaaagaagtcattatatgaaaaagatacttgtacacatatatttatagcagcacaacttgcaactgtgaaatcatgggaccaacccaaatgtccatcagtcaacgagtggataaagaaactgtggtttaccgacaagactgtgaaactttcgggatggtggtgaaaatgctgattgaaaaagatccttcattagaaaagtctatacagtttgcattgaggcagaatttacatgaaatagagtctgcaggacagacttggcagcaggtaccccctgtgaggaacactgaaatggatcacgacggaacccccgaaaacgaaggcgaagagactgcgcagtcagccctctttggattccagcacgacgcatcaaaccataccatagtggggctaggacccaaccaagtaccagaaatgaaggaaacgaccctgcaggccccgcagcccccgcaggccccgcagcccctgcagccccggaagaaacgggttcgtcggacgacacagcttcgtcggacgacaggagccccagacattacctgggggatgctgaagaagacaactcaggaggctgagaggatcctgctccgaacacagacaccattcactccagaaaatttgttccttgctatgctctctgttgtacattgcaactcacgcaaggatgtaaagccagaaaacaagcagtaa

SEQ ID NO: 6706 - DNA, 520 bp, synthetic construct
  misc_feature 1..520: note = Synthetic polypeptide
  source 1..520: mol_type = other DNA
aattcaagcctcctactttctgactgtttgatctaggccctgcctgcagtactggccagagccaggccggcagcaatatggcctcatggaggtggagtttatgtcgggcacagctgatgaagacttagtggctcgagtcttccgggtgcagaacatctctcggttgcaggaggggcacctgctggtgcggcacttccagttcctgcgctggtctgcataccgggacacacctgactccaagaaggccttcttgcacctgctggctgaggtggacaagtggcaggccgagagtggggatgggcgcaccatcgtgcactgcctaaacgggggaggacgcagcggcaccttctgcgcctgcgccacggtcctggagatgatccgctgccacaacttggtggacgttttctttgctgccaaaaccctccggaactacaaacccaacatggtggagaccatggatcagtaccacttttgctacgatgtggccctggagtacttggaggggctggagtcaagatag

SEQ ID NO: 6707 - DNA, 514 bp, synthetic construct
  misc_feature 1..514: note = Synthetic polypeptide
  source 1..514: mol_type = other DNA
aattcaagcctcctactttctgactgtttgatctaggccctgcctgcagtactggccagagccaggccggcagcaatatggcctcatggaggtggagtttatgtcgggcacagctgatgaagacttagtggctcgagtcttccgggtgcagaacatctctcgggaggggcacctgctggtgcggcacttccagttcctgcgctggtctgcataccgggacacacctgactccaagaaggccttcttgcacctgctggctgaggtggacaagtggcaggccgagagtggggatgggcgcaccatcgtgcactgcctaaacgggggaggacgcagcggcaccttctgcgcctgcgccacggtcctggagatgatccgctgccacaacttggtggacgttttctttgctgccaaaaccctccggaactacaaacccaacatggtggagaccatggatcagtaccacttttgctacgatgtggccctggagtacttggaggggctggagtcaagatag

SEQ ID NO: 6708 - DNA, 1291 bp, synthetic construct; identical to SEQ ID NO: 6699
  misc_feature 1..1291: note = Synthetic polypeptide
  source 1..1291: mol_type = other DNA

SEQ ID NO: 6709 - DNA, 290 bp, synthetic construct
  misc_feature 1..290: note = Synthetic polypeptide
  source 1..290: mol_type = other DNA
ggctgggcgcagtggctcatgcctgtaatcccaacactttgggaggccgaggtgggcggatcacaaggctacggaaaaacctgcgagccctggtggttgtccatgctacatggtatgtgaaagcatttctggcactgcttcggcccttcatcagttccaaattcacacgaaaaatccgttttctggacagcctgggggagctggcccaactcatatccctggatcaagtccacatccctgaagctgtcagacagctggaccgggatctccatggctcaggagggacatag

SEQ ID NO: 6710 - DNA, 1730 bp, synthetic construct
  misc_feature 1..1730: note = Synthetic polypeptide
  source 1..1730: mol_type = other DNA
ggccaggtgcagtggcctgtaataacagcactttgagaggcaaagacagaaggatcccttgaggccaggagttggagaacagcctgggcaacatagcaagatcccacttctaaaaaaagtattccaaaatcaagcatttgctgaaggacctggatgagctgatggaagctgtcctggagagaatcctggctcctgagctaagccatgccaatgccaccaggaacctgaacttctccatctggaaccacacacccctggtccttattgatgaacggaacccccaccaccccatggtccttgatctctttggagacaaccacaatggcttaacaagcagctcagcatcagaaaagatctgtaatgcccacgggtgcaaaatggccatgagactatgtagcctcaacaggacccagtgtaccttccggaacttcaccagtgctacccaggcattgacagagtggtacatcctgcaggccaccaacatctttgcacaggtgccacagcaggagctagtagagatgagctaccccggcgagcagatgatcctggcctgcctattcggagctgagccctgcaactaccggaacttcacgtccatcttctaccctcactatggcaactgttacatcttcaactggggcatgacagagaaggcacttccttcggccaaccctggaactgaattcggcctgaagttgatcctggacataggccaggaagactacgtccccttccttgcgtccacggccggggtcaggctgatgcttcacgagcagaggtcataccccttcatcagagatgagggcatctacgccatgtcggggacagagacgtccatcggggtactcgtggacaagcttcagcgcatgggggagccctacagcccgtgcaccgtgaatggttctgaggtccccgtccaaaacttctacagtgactacaacacgacctactccatccaggcctgtcttcgctcctgcttccaagaccacatgatccgtaactgcaactgtggccactacctgtacccactgccccgtggggagaaatactgcaacaaccgggacttcccagactgggcccattgctactcagatctacagatgagcgtggcgcagagagagacctgcattggcatgtgcaaggagtcctgcaatgacacccagtacaagatgaccatctccatggctgactggccttctgaggcctccgaggactggattttccacgtcttgtctcaggagcgggaccaaagcaccaatatcaccctgagcaggaagggaattgtcaagctcaacatctacttccaagaatttaactatcgcaccattgaagaatcagcagccaataacatcgtctggctgctctcgaatctgggtggccagtttggcttctggatggggggctctgtgctgtgcctcatcgagtttggggagatcatcatcgactttgtgtggatcaccatcatcaagctggtggccttggccaagagcctacggcagcggcgagcccaagccagctacgctggcccaccgcccaccgtggccgagctggtggaggcccacaccaactttggcttccagcctgacacggccccccgcagccccaacactgggccctaccccagtgagcaggccctgcccatcccaggcaccccgccccccaactatgactccctgcgtctgcagccgctggacgtcatcgagtctgacagtgagggtgatgccatctaa

SEQ ID NO: 6711 - DNA, 698 bp, synthetic construct
  misc_feature 1..698: note = Synthetic polypeptide
  source 1..698: mol_type = other DNA
ggccaggtgcagtggcctgtaataacagcactttgagaggcaaagacagaaggatcccttgaggccaggagttggagaacagcctgggcaacatagcaagatcccacttctaaaaaaagtattccaaaatcaagcatttgctgaaggacctggatgagctgatggaagctgtcctggagagaatcctggctcctgagctaagccatgccaatgccaccaggaacctgaacttctccatctggaaccacacacccctggtccttattgatgaacggaacccccaccaccccatggtccttgatctctttggagacaaccacaatggcttaacaagcagctcagcatcagaaaagatctgtaatgcccacgggtgcaaaatggccatgagactatgtagcctcaacaggacccagtgtaccttccggaacttcaccagtgctacccaggcattgacagagtggtacatcctgcaggccaccaacatctttgcacaggtgccacagcaggagctagtagagatgagctaccccggcgagcagatgatcctggcctgcctattcggagctgagccctgcaactaccggcctgaagttgatcctggacataggccaggaagactacgtccccttccttgcgtccacggccggggtcaggctgatgcttcacgagcagaggtcataccccttcatcagagatga

SEQ ID NO: 6712 - DNA, 1622 bp, synthetic construct
  misc_feature 1..1622: note = Synthetic polypeptide
  source 1..1622: mol_type = other DNA
ggccaggtgcagtggcctgtaataacagcactttgagaggcaaagacagaaggatcccttgaggccaggagttggagaacagcctgggcaacatagcaagatcccacttctaaaaaaagtattccaaaatcaagcatttgctgaaggacctggatgagctgatggaagctgtcctggagagaatcctggctcctgagctaagccatgccaatgccaccaggaacctgaacttctccatctggaaccacacacccctggtccttattgatgaacggaacccccaccaccccatggtccttgatctctttggagacaaccacaatggcttaacaagcagctcagcatcagaaaagatctgtaatgcccacgggtgcaaaatggccatgagactatgtagcctcaacaggacccagtgtaccttccggaacttcaccagtgctacccaggcattgacagagtggtacatcctgcaggccaccaacatctttgcacaggtgccacagcaggagctagtagagatgagctaccccggcgagcagatgatcctggcctgcctattcggagctgagccctgcaactaccggaacttcacgtccatcttctaccctcactatggcaactgttacatcttcaactggggcatgacagagaaggcacttccttcggccaaccctggaactgaattcggcctgaagttgatcctggacataggccaggaagactacgtccccttccttgcgtccacggccggggtcaggctgatgcttcacgagcagaggtcataccccttcatcagagatgagggcatctacgccatgtcggggacagagacgtccatcggggtactcgtggcctgtcttcgctcctgcttccaagaccacatgatccgtaactgcaactgtggccactacctgtacccactgccccgtggggagaaatactgcaacaaccgggacttcccagactgggcccattgctactcagatctacagatgagcgtggcgcagagagagacctgcattggcatgtgcaaggagtcctgcaatgacacccagtacaagatgaccatctccatggctgactggccttctgaggcctccgaggactggattttccacgtcttgtctcaggagcgggaccaaagcaccaatatcaccctgagcaggaagggaattgtcaagctcaacatctacttccaagaatttaactatcgcaccattgaagaatcagcagccaataacatcgtctggctgctctcgaatctgggtggccagtttggcttctggatggggggctctgtgctgtgcctcatcgagtttggggagatcatcatcgactttgtgtggatcaccatcatcaagctggtggccttggccaagagcctacggcagcggcgagcccaagccagctacgctggcccaccgcccaccgtggccgagctggtggaggcccacaccaactttggcttccagcctgacacggccccccgcagccccaacactgggccctaccccagtgagcaggccctgcccatcccaggcaccccgccccccaactatgactccctgcgtctgcagccgctggacgtcatcgagtctgacagtgagggtgatgccatctaa

SEQ ID NO: 6713 - DNA, 1649 bp, synthetic construct
  misc_feature 1..1649: note = Synthetic polypeptide
  source 1..1649: mol_type = other DNA
ggccaggtgcagtggcctgtaataacagcactttgagaggcaaagacagaaggatcccttgaggccaggagttggagaacagcctgggcaacatagcaagatcccacttctaaaaaaagtattccaaaatcaagcatttgctgaaggacctggatgagctgatggaagctgtcctggagagaatcctggctcctgagctaagccatgccaatgccaccaggaacctgaacttctccatctggaaccacacacccctggtccttattgatgaacggaacccccaccaccccatggtccttgatctctttggagacaaccacaatggcttaacaagcagctcagcatcagaaaagatctgtaatgcccacgggtgcaaaatggccatgagactagccaccaacatctttgcacaggtgccacagcaggagctagtagagatgagctaccccggcgagcagatgatcctggcctgcctattcggagctgagccctgcaactaccggaacttcacgtccatcttctaccctcactatggcaactgttacatcttcaactggggcatgacagagaaggcacttccttcggccaaccctggaactgaattcggcctgaagttgatcctggacataggccaggaagactacgtccccttccttgcgtccacggccggggtcaggctgatgcttcacgagcagaggtcataccccttcatcagagatgagggcatctacgccatgtcggggacagagacgtccatcggggtactcgtggacaagcttcagcgcatgggggagccctacagcccgtgcaccgtgaatggttctgaggtccccgtccaaaacttctacagtgactacaacacgacctactccatccaggcctgtcttcgctcctgcttccaagaccacatgatccgtaactgcaactgtggccactacctgtacccactgccccgtggggagaaatactgcaacaaccgggacttcccagactgggcccattgctactcagatctacagatgagcgtggcgcagagagagacctgcattggcatgtgcaaggagtcctgcaatgacacccagtacaagatgaccatctccatggctgactggccttctgaggcctccgaggactggattttccacgtcttgtctcaggagcgggaccaaagcaccaatatcaccctgagcaggaagggaattgtcaagctcaacatctacttccaagaatttaactatcgcaccattgaagaatcagcagccaataacatcgtctggctgctctcgaatctgggtggccagtttggcttctggatggggggctctgtgctgtgcctcatcgagtttggggagatcatcatcgactttgtgtggatcaccatcatcaagctggtggccttggccaagagcctacggcagcggcgagcccaagccagctacgctggcccaccgcccaccgtggccgagctggtggaggcccacaccaactttggcttccagcctgacacggccccccgcagccccaacactgggccctaccccagtgagcaggccctgcccatcccaggcaccccgccccccaactatgactccctgcgtctgcagccgctggacgtcatcgagtctgacagtgagggtgatgccatctaa

SEQ ID NO: 6714 - DNA, 279 bp, synthetic construct
  misc_feature 1..279: note = Synthetic polypeptide
  source 1..279: mol_type = other DNA
aatggaaaagtctggagattggagccaggcaaaaaaatctgcatttcggttgtctagaactacctgagtgacttcggctgcttcctaccgaacctgaattttctgtgatgtggagacatttaataccacctttagggaactggcttaaggactggagactgggctggcttagatgaagatgaagatgcacatgtctgggaggataattgggatgatgacaatgtagaggatgacttctctaatcagttacgggctggatacagtgaactggaggaatag

SEQ ID NO: 6715 - DNA, 270 bp, synthetic construct
  misc_feature 1..270: note = Synthetic polypeptide
  source 1..270: mol_type = other DNA
aatggaaaagtctggagattggagccaggcaaaaaaatctgcatttcggttgtctagaactacctgagtgacttcggctgcttcctaccgaacctgaattttctgtgatgtggagacatttaataccacctttagggaactggcttaaggactggagactgggctggcttagatgaagatgaagatgcacatgtctgggaggataattgggatgatgacaatgtagaggatgacttctctaatcagttacgctgtgagaaaaagccctga

SEQ ID NO: 6716 - DNA, 351 bp, synthetic construct
  misc_feature 1..351: note = Synthetic polypeptide
  source 1..351: mol_type = other DNA
aatggaaaagtctggagattggagccaggcaaaaaaatctgcatttcggttgtctagaactacctgagtgacttcggctgcttcctaccgaacctgaattttctgtgatgtggagacatttaataccacctttagggaactggcttaaggactggagactgggctggcttagatgaagatgaagatgcacatgtctgggaggataattgggatgatgacaatgtagaggatgacttctctaatcagttacgggcaactgtactcctgatgatattggtctgtgaaaccccgtatggctgctatgttctccaccaaaagggaagaatgtgcagtgctttcctctgctgttaa

SEQ ID NO: 6717 - DNA, 294 bp, synthetic construct
  misc_feature 1..294: note = Synthetic polypeptide
  source 1..294: mol_type = other DNA
aatggaaaagtctggagattggagccaggcaaaaaaatctgcatttcggttgtctagaactacctgagtgacttcggctgcttcctaccgaacctgaattttctgtgatgtggagacatttaataccacctttagggaactggcttaaggactggagactgggctggcttagatgaagatgaagatgcacatgtctgggaggataattgggatgatgacaatgtagaggatgacttctctaatcagttacgagctgaactagagaaacatggttataagatggagacttcatag

SEQ ID NO: 6718 - DNA, 1046 bp, synthetic construct; identical to SEQ ID NO: 631
  misc_feature 1..1046: note = Synthetic polypeptide
  source 1..1046: mol_type = other DNA

SEQ ID NO: 6719 - DNA, 968 bp, synthetic construct; identical to SEQ ID NO: 632
  misc_feature 1..968: note = Synthetic polypeptide
  source 1..968: mol_type = other DNA

SEQ ID NO: 6720 - DNA, 676 bp, synthetic construct; identical to SEQ ID NO: 634
  misc_feature 1..676: note = Synthetic polypeptide
  source 1..676: mol_type = other DNA

SEQ ID NO: 6721 - DNA, 494 bp, synthetic construct; identical to SEQ ID NO: 635
  misc_feature 1..494: note = Synthetic polypeptide
  source 1..494: mol_type = other DNA

SEQ ID NO: 6722 - DNA, 961 bp, synthetic construct
  misc_feature 1..961: note = Synthetic polypeptide
  source 1..961: mol_type = other DNA
ggctgggtgtggtggctcacacctgtaatcccagcactttaagaggccaaggcaggaggagcgcttgagcccagaagtttgagaccaggctgtgcaacatagcaagacccccgtctctacaaaaaattaaaaaatttagccagggtttttggagtctctggatgatttttacattcttagcagtggattgatattgctgcagaccacaaacagtgtgtttaataaaaccctgctaaagcaggtaatacccgagactctcctgtcctggcaaagagtccgtgtggccaatatgatggcagatagtggcaagaggtgggcagacatcttttcaaaatacaactctggcacctataacaatcaatacatggttctggacctgaagaaagtaaagctgaaccacagtcttgacaaaggcactctgtacattgtggagcaaattcctacatatgtagaatattctgaacaaactgatgttctacggaaaggatattggccctcctacaatgttcctttccatgaaaaaatctacaactggagtggctatccactgttagttcagaagctgggcttggactactcttatgatttagctccacgagccaaaattttccggcgtgaccaagggaaagtgactgatacggcatccatgaaatatatcatgcgatacaacaattataagaaggatccttacagtagaggtgacccctgtaataccatctgctgccgtgaggacctgaactcacctaacccaagtcctggaggttgttatgacacaaaggtggcagatatctacctagcatctcagtacacatcctatgccataagtggtcccacagtacaaggtggcctccctgtttttcgctgggaccgtttcaacaaaactctacatcagggcatgccagaggtctacaactttgattttattaccatgaaaccaattttgaaacttgatataaaatga

SEQ ID NO: 6723 - DNA, 303 bp, synthetic construct
  misc_feature 1..303: note = Synthetic polypeptide
  source 1..303: mol_type = other DNA
agtagaacgaacaggccctggtgcgaggaagggtttgacccaggctctgccattgccacctgcatgactaggatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaa

SEQ ID NO: 6724 - DNA, 189 bp, synthetic construct
  misc_feature 1..189: note = Synthetic polypeptide
  source 1..189: mol_type = other DNA
agtagaacgaacaggccctggtgcgaggaagggtttgacccaggctctgccattgccacctgcatgactaggatggagaaggatgaaactgtgagtgactgctccccacacatagccaacatcgggcgcctggtagaggtctgtgcagacttttgcagacaaatcaaaacaagaagctctgaagaatga

SEQ ID NO: 6725 - DNA, 318 bp, synthetic construct
  misc_feature 1..318: note = Synthetic polypeptide
  source 1..318: mol_type = other DNA
agtagaacgaacaggccctggtgcgaggaagggtttgacccaggctctgccattgccacctgcatgactaggatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgagatctattgatgctatccctgacaaccaaaagtttaagcagttgcagagggagctctctcaagtgctgacccagcgccagatctacatccagcctgataattaa

SEQ ID NO: 6726 - DNA, 138 bp, synthetic construct
  misc_feature 1..138: note = Synthetic polypeptide
  source 1..138: mol_type = other DNA
agtagaacgaacaggccctggtgcgaggaagggtttgacccaggctctgccattgccacctgcatgactaggatggagaaggatgaaactgtgagtgactgctccccacacatagccaacatcgggcgcctggtagag

SEQ ID NO: 6727 - DNA, 2825 bp, synthetic construct
  misc_feature 1..2825: note = Synthetic polypeptide
  source 1..2825: mol_type = other DNA
caggttatgaaacaaattgattctagcaggccagacttaagagagatgagccccttgaccatcccaaggcagagtggttaacagatgcaagttgttttatgcatcaggaaaacaggagggctagatatgctattattagcacaagataatcaaggcacaagccttgctggcctcgacctcagctcaaaaagctgagttaattgaacttactaggcccctgcagttggaaaggatttaaaagttaacatttacactgattccaagtatgattttttagtgcttcatgcttatgctgcaatttggaatgggtggggactcctgaccccaaagggcttttccatacatcattcagattttgagcttgttagaatgctgctttgctgccaaaaagtgactataattaattgcagaggacatcaaaagagagactgaccatgtaaaaggaaatgcccttgtagatgccacagccaaggcccctgcactgaaagggccaatgaagcttgtgggcgtgctggtcagcatacatagaactgggccggaataccctgaagaagaacaaaaatgggccagggattgcatttcagtccagggcccctcaggctgaatgatggtaataaattactaatgccaagtaccaatcacaggagtataactcagcactttcatgattcttttcaccctagaagggattctttgtttctgttaatgtctcatttgtttataggggtaaatcttttcaagacactaaaacaggtgactcagccctgtgagctctgtgcctgacatgacccaaacggccagcaattttctccttctccagttaaacctgtccaaaattgaggaacctatccaggtgagaactggcaactctaatgtactccgatacctttctgcaggagattcaaatatttgctaatgcttactgataccttcactggttagatcgaggcattccccaccccatctgaaaaatgtttaccagaagaaataactcctcagtttcggtaatctaaaagcctgcaaagtgacaatggcccatctttcacagcaggcgtaacccaacacctatcctcagctttaagaatccaatattaccttcactctgtgtggagaccgcagtcctctggaaaggtgaaagggctaatcctactctacagaagactccagctaaatcagacgcctgactatctccaacacccatagcttactgcgggtttgaactgctccaaagtaaaacgtataattaagtcctgttgagttaacatatggaaggcctttcctaaccacagatctcctaatagatgaaatgaatctccattacaaaaatatcaatctaggacaggtgcaaaggcactccgtgcatatggaaacaagcgtcttcccctcccacatgggaggaaaattcagtttcagctcagctagggatctagtcttactaaagacgtgggaagaagttctccagctgagcagctttccccaacgtggaagggaccatagcaaggacacctgagttctccaacagacgttcaacgccaagggattcacagttctgggaggtgatctctgatgaacatgccatcgactccgctggcacctaccacggggacagccacctgcagctggagcgcatcaacgtgcaccaccacgaggccagcggtggcaggtacgtgccccgcgctgtgctcgtggatctggagccgggcaccatggactctgtgcactcggggcccttcgggcaggtcttcaggccagacaacttcatttccggtcagtgtggggccggaaacaactgggccaagggacgctacacagaaggcgcggagctgacggagtcagtgatggacgttgtcagaaaggaggctgagagctgtgactgcctgcagggtttccagctgacccactccctgggtggggggactgggtctgggatgggtacccttctcattagtaagatccgggaggagtacccagacaggatcataaacacattcagcatcctgccctcgcccaaggtgtcggacaccgtggtggagccctacaacgccaccctctcagtccaccagctcatagaaaacgcggatgagaccttctgcatagataacgaagcgctatatgacatatgttccaggaccctaaaactgcccacacccacctatggtgacctgaaccacctggtgtctgctaccatgagtggggtcaccacatgcctgcgcttcccaggccagctgaatgctgacctgcggaagctggccgtgaacatggtcccgtttccccggctgcatttcttcatgcccggctttgccccactgaccagccggggcagccagcagtaccgggccttgactgtggctgagctcacccagcagatgtttgatgctaagaacatgatggctgcctgtgacccccgtcacggctgctacctaacggtggctgccattttcaggggtcgcatgcccatgagggaggtggatgaacaaatgttcaacattcaagataagaacagcagctactttgctgactggttccccgacaacgtaaaaacagccgtctgtgacatcccaccccgggggctaaaaatgtcagccaccttcattgggaataatgcggccatccaggaactcttcacatgtgtctcagagcagtttacagcaatgttcaggcgcaaggccttcctccactggtacacgggcgagggcatggatgagatggaattcaccgaggccgagagcaacatgaacgacctggtgtctgaatatcagcaatatcaggatgccacggccgaggaggaggaggatgaggagtatgccgaggaggaggtggcctag

SEQ ID NO: 6728 - DNA, 394 bp, synthetic construct; identical to SEQ ID NO: 701
  misc_feature 1..394: note = Synthetic polypeptide
  source 1..394: mol_type = other DNA

SEQ ID NO: 6729 - DNA, 700 bp, synthetic construct; identical to SEQ ID NO: 702
  misc_feature 1..700: note = Synthetic polypeptide
  source 1..700: mol_type = other DNA

SEQ ID NO: 6730 - DNA, 568 bp, synthetic construct; identical to SEQ ID NO: 703
  misc_feature 1..568: note = Synthetic polypeptide
  source 1..568: mol_type = other DNA

SEQ ID NO: 6731 - DNA, 535 bp, synthetic construct; identical to SEQ ID NO: 704
  misc_feature 1..535: note = Synthetic polypeptide
  source 1..535: mol_type = other DNA

SEQ ID NO: 6732 - DNA, 129 bp, synthetic construct; identical to SEQ ID NO: 705
  misc_feature 1..129: note = Synthetic polypeptide
  source 1..129: mol_type = other DNA

SEQ ID NO: 6733 - DNA, 435 bp, synthetic construct; identical to SEQ ID NO: 706
  misc_feature 1..435: note = Synthetic polypeptide
  source 1..435: mol_type = other DNA

SEQ ID NO: 6734 - DNA, 303 bp, synthetic construct; identical to SEQ ID NO: 707
  misc_feature 1..303: note = Synthetic polypeptide
  source 1..303: mol_type = other DNA

SEQ ID NO: 6735 - DNA, 270 bp, synthetic construct; identical to SEQ ID NO: 708
  misc_feature 1..270: note = Synthetic polypeptide
  source 1..270: mol_type = other DNA

SEQ ID NO: 6736 - DNA, 290 bp, synthetic construct
  misc_feature 1..290: note = Synthetic polypeptide
  source 1..290: mol_type = other DNA
ggccaggcacggtggctcacgcctgtaatcccagcactttgggaggccgaggtgggcggatcacaaggctacggaaaaacctgcgagccctggtggttgtccatgctacatggtatgtgaaagcatttctggcactgcttcggcccttcatcagttccaaattcacacgaaaaatccgttttctggacagcctgggggagctggcccaactcatatccctggatcaagtccacatccctgaagctgtcagacagctggaccgggatctccatggctcaggagggacatag

SEQ ID NO: 6737 - DNA, 864 bp, synthetic construct
  misc_feature 1..864: note = Synthetic polypeptide
  source 1..864: mol_type = other DNA
tgttataggaaatagaaataaagtatttgggtagacggggagaagagagtccctggcagaaaactttccttctaacataaagtagctcagaaatagctcccttctaacctcatgcagttcaaagaaatcacttctctaactaaacaagcagcctgaaagatcaggctgtaaatcacagataaacccctggagcacagaaggagggcggggagtctcctgggtaatcaccaaacttcacaatgggccccagtaaaaacagtgggccttaataagcacattcctttccctttaggacatcaagatagagaagctaaaagtggacttggggaggtgggggtggagacgtcgtgggggaggggtgttggggggatgcctgcagctgcaagaagatgtctgggaacagacacagaaactctccctctcagataagcaaaagaaggcatcacagactaagtctgcccatgtgatccaggaataaagtgagagctgataaaaaaaaaaactctgctctataaagatagcacacctggtcccaactaaatcgtcaggccctaggaggataagacatcccctcctcactggcaccacccccgccacctgccactaactccctcctcactagcccatttataaaaaccctgacatttttactaagcaactcactcgggacccatctcttcaagggagagctgttctttctttttgcctattcaactttgctccaaactcaagtctgtgtgtgtagtgtgtgttcgcgacctccgtctccttgactgttcgaccaagagccttggtggatctccttacgtagcagccaaaataaatgaagcaaaagacttgctagaaacaaccaccaaacattga

SEQ ID NO: 6738 - DNA, 154 bp, synthetic construct
  misc_feature 1..154: note = Synthetic polypeptide
  source 1..154: mol_type = other DNA
ggaagaggccagaactggagagagacagaaccaggctacactgcagttctattccccttactagggcttggagaagatctctgcctacatgaagtccagccgcttcctcccaagacctgtgttctcaaagatggctgtctggggcaacaagtag

SEQ ID NO: 6739 - DNA, 164 bp, synthetic construct; identical to SEQ ID NO: 831
  misc_feature 1..164: note = Synthetic polypeptide
  source 1..164: mol_type = other DNA

SEQ ID NO: 6740 - DNA, 193 bp, synthetic construct; identical to SEQ ID NO: 834
  misc_feature 1..193: note = Synthetic polypeptide
  source 1..193: mol_type = other DNA

SEQ ID NO: 6741 - DNA, 2588 bp, synthetic construct
  misc_feature 1..2588: note = Synthetic polypeptide
  source 1..2588: mol_type = other DNA
aagttaaacatggaatagctatgtgactcagcaattccaaggtaagatgtaaaagaattgaaaagaagcattcaaacaaatacttctacacaaatgttcacagcagcagcagcagcactatttgtaataaccaaaaggtagaaacaagccaagtgttcatcaactgatgagtaggtaaacaaaatgtggtctatccatacaatggaatgttattgtatgaagtgctgatacatgctgtgacatggatcagccttgaaagtatgatgctaaatgaaagacaccagacacgaaagtcacgtgttgtatgatgccatttctatggaatgtccagcataggcaagtccacagatacagagtaaactggtggttttcaaggcctggagagagacggagtggctgcttaatagtatgaagagagggatacactggctcacagtgccccacttttaactgaaaaaaccttcaacaagcttgtgggaaagtttagccagtccatctttcacttgaatttaacacaaatactctcagccacaatggaagggaagctggttgtctgggacatacaccgcccaccctcatctgcctccacctttttgggctttccctatatcaagccttgtaaattggttcatttgcagaaagagggtatcacggtacttaccacaattgatagctacattgtcacaggtgacattaaggggaacattaagttctatgatcacaccctgtctattgttaactggtacagtcacttgaaactgggcgccataagaactctgtccttttcaaagaccccagcaactcctcctactgaaaaatcaaactatcctcctgactgcactttaaaaggtgacctttttgtcttaaggaattttatcattggaacatctgatgccgcggtgtaccacttaacaacagatgggaccaaacttgagaagttatttgtagagcccaaggatgccatttgtgccatctcctgccacccatatcaacccctcattgccatcgggagcatctgtgggatgatcaaagtgtggaattatgaaaacaaacaatatcttttcagcagggtttttgagaaggggcttggagtccagagtctgacctacaaccccgaaggagcccttcttggagctggctttacagaggggacagtttacattcttgatgcaatgtctttagaaaatgaaagcccagagcctttcaaatattccagaaccagtgtgactcatataagcttttcccatgactcccagtatatggcaactgctgatagaagttttactgtggctgtttacatgctggtggtcagaaatggacagagggtctgggagtacttagcaagacttcgctctcatcgcaaaagcattcgaagtctcctgtttggggtttacctggacagcaatgagcctagactgctgagccttgggacagacaggctcttgatagagtatgatcttctcaggagctacaaagaccacctggaagtcctggacattcaccacaccgaccagggctgctatcccacctgcatggtctggtacccaccactcaccagggaactcttcctgcttatttgcaacagtggctacaaagtgaagctttttaatgctactaccaaaatgtgcagaaagacgcttctggggccagcttatggttcccctattgagcagacacaagtcctcccagtgagaagcatggcggagctacagaaacgctacttggtgtttattaacagagacaaggtgggacttcagatcttaccagttgacggcaatccacataagacatctgctattgtttgccacccgaacggggtggccggcatggccgtttcctatgatggctgctacgccttcactgcgggagggcacgatcgctcggtggtgcagtggaaaatcaccttaagtgtcctggaggcagcggtttctcttgggggtgaagacttgaccccattctatggtctgctgtctggtggccgggaaggaaaattctacagggagctagaagactacttctactattctcagctccgcagtcaaggcatcgacacaatggagaccagaaaggtgtcagaacacatttgcctgtcagagcttccttttgtcatgagagcaattggcttttacccatctgaagagaagattgatgatatatttaacgaaatcaaatttggtgaatatgtggacactggaaagctaatcgacaagatcaacttaccagatttcctaaaagtgtaccttaaccacaagccaccttttggtaacaccatgagtggcatccacaagagctttgaggtgctcggttataccaactccaaagggaaaaaggccattcgaagagaggacttcctgagactgctcgttactaaaggtgagcatatgacggaggaggagatgttggattgctttgcttcactgtttggcctgaatcccgagggatggaaatccgagcctgcaacctgctccgtcaaaggttcagaaatttgccttgaagaagaacttccagacgaaatcactgcagaaatattcgcgactgaaattcttggcttaaccatttcagaagattccggccaggatggtcagtga

SEQ ID NO: 6742 - DNA, 1964 bp, synthetic construct
  misc_feature 1..1964: note = Synthetic polypeptide
  source 1..1964: mol_type = other DNA
aagttaaacatggaatagctatgtgactcagcaattccaaggtaagatgtaaaagaattgaaaagaagcattcaaacaaatacttctacacaaatgttcacagcagcagcagcagcactatttgtaataaccaaaaggtagaaacaagccaagtgttcatcaactgatgagtaggtaaacaaaatgtggtctatccatacaatggaatgttattgtatgaagtgctgatacatgctgtgacatggatcagccttgaaagtatgatgctaaatgaaagacaccagacacgaaagtcacgtgttgtatgatgccatttctatggaatgtccagcataggcaagtccacagatacagagtaaactggtggttttcaaggcctggagagagacggagtggctgcttaatagtatgaagagagggatacactggctcacagtgccccacttttaactgaaaaaaccttcaacaagcttgtgggaaagtttagccagtccatctttcacttgaatttaacacaaatactctcagccacaatggaagggaagctggttgtctgggacatacaccgcccaccctcatctgcctccacctttttgggctttccctatatcaagccttgtaaattggttcatttgcagaaagagggtatcacggtacttaccacaattgatagctacattgtcacaggtgacattaaggggaacattaagttctatgatcacaccctgtctattgttaactggtacagtcacttgaaactgggcgccataagaactctgtccttttcaaagaccccagcaactcctcctactgaaaaatcaaactatcctcctgactgcactttaaaaggtgacctttttgtcttaaggaattttatcattggaacatctgatgccgcggtgtaccacttaacaacagatgggaccaaacttgagaagttatttgtagagcccaaggatgccatttgtgccatctcctgccacccatatcaacccctcattgccatcgggagcatctgtgggatgatcaaagtgtggaattatgaaaacaaacaatatcttttcagcagggtttttgagaaggggcttggagtccagagtctgacctacaaccccgaaggagcccttcttggagctggctttacagaggggacagtttacattcttgatgcaatgtctttagaaaatgaaagcccagagcctttcaaatattccagaaccagtgtgactcatataagcttttcccatgactcccagtatatggcaactgctgatagaagttttactgtggctgtttacatgctggtggtcagaaatggacagagggtctgggagtacttagcaagacttcgctctcatcgcaaaagcattcgaagtctcctgtttggggtttacctggacagcaatgagcctagactgctgagccttgggacagacaggctcttgatagagtatgatcttctcaggagctacaaagaccacctggaagtcctggacattcaccacaccgaccagggctgctatcccacctgcatggtctggtacccaccactcaccagggaactcttcctgcttatttgcaacagtggctacaaagtgaagctttttaatgctactaccaaaatgtgcagaaagacgcttctggggccagcttatggttcccctattgagcagacacaagtcctcccagtgagaagcatggcggagctacagaaacgctacttggtgtttattaacagagacaaggtgggacttcagatcttaccagttgacggcaatccacataagacatctgctattgtttgccacccgaacggggtggccggcatggccgtttcctatgatggctgctacgccttcactgcgggagggcacgatcgctcggtggtgcagtggaaaatcaccttaagccatcctgggagccaggcaccaatattatccccatcagacacatcaagaagctaa

SEQ ID NO: 6743 - DNA, 1536 bp, synthetic construct
  misc_feature 1..1536: note = Synthetic polypeptide
  source 1..1536: mol_type = other DNA
agaaaaagaagctgtgaaaagagaaaagcgagaggaaaagtagaagaaaaagaaataaggaccatcctaaactccatgcacaagtaccagccgcgcttccacatagtgcgagccaacgacatcctgaagctgccttacagcaccttccgcacctacgtgttcccggagaccgacttcatcgccgtcactgcctaccagaatgacaagatcacacagctgaagatcgacaacaacccgtttgccaagggcttccgggacaccgggaacggccggcgggagaaaaggaagcagctgacgctgccgtctctacgcttgtacgaggagcactgcaaacccgagcgcgatggcgcggagtcagacgcctcgtcgtgcgaccctccccccgcgcgggaaccacccacctccccgggcgcagcgcccagtccgctgcgcctgcaccgggcccgagctgaggagaagtcgtgcgccgcggacagcgacccggagcctgagcggttgagcgaggagcgtgcgggggcgccgctaggccgcagcccggctccagacagcgccagccccactcgcttgaccgaacccgagcgcgcccgggagcggcgtagtcccgagaggggcaaggagccggccgagagcggcggggacggcccgttcggcctgaggagcctggagaaggagcgcgccgaagctcggaggaaggacgaggggcgcaaggaggcggccgagggcaaggagcagggcctggcgccgctggtggtgcagacagacagtgcgtcccccctgggcgccggacacctgcccggcctggccttttccagccacttgcacgggcagcagttctttgggccgctgggagccggccagccgctcttcctgcaccctggacagttcaccatgggccctggcgccttctccgccatgggcatgggtcacctactggcctcggtggcaggcggcggcaacggcggaggtggcgggcctgggaccgccgcggggctggacgcaggcgggctgggtcccgcggccagcgcagcaagcaccgccgcgcccttcccgttccacctctcccagcacatgctggcatctcagggaattccaatgcccactttcggaggcctcttcccctacccctacacctacatggcagcagcagccgcagccgcctcggctttgcccgccactagtgctgcagctgccgccgccgcagccgccggctccctctcccggagccccttcctgggcagtgcccggccccgactgcgtttcagcccctatcagatcccggtcaccatcccgcctagcactagcctcctcaccaccgggctggcctctgagggctccaaggccgctggtggaaacagccgggagcctagccccctgcccgagctggctctccgcaaagtaggggccccatcccgcggtgccctgtcgcccagtggctcggccaaggaggcggccaatgaactgcagagcatccagagactggtgagtgggctggagagccagcgagccctctccccaggccgggagtcgcccaagtga

SEQ ID NO: 6744 - DNA, 748 bp, synthetic construct
  misc_feature 1..748: note = Synthetic polypeptide
  source 1..748: mol_type = other DNA
tgatacggtttggctgtgtccgcactcaaatctcatgctgaattgcagttcccattatccctatgtgtcctgggaaggacccggagggaggtagttgaatcaagggggcggttaccctcatgcggttctcgtgatagcaagtgagttctcacgagatctgatggttttatagaggctttcccctccttccctctgcacttctcgctgctgccacgtcgcaaaggaagtgttttcttctccttccgccatgattataaatttcctgaggcctccccagccctgcggaactaagaggaagagacaccagagatgtgcacactcagagacaagacacatgaggacacagagacaaggcggctacctgcaagccagggagaggggcctcggggaagccaaccctgcctacgccttgatcttggacttccagcctccagaactccagaatctgagtgaaatgggtataaatcatgagctaggatacagttcaattattcctatgatgaaaagagctttctccgcatgtgggactctcggcctcattatgagtggcatctttgacaatccagggcccattaaaaacaccttgaagaaagcattcaccatgctgtggagcttcacagtctataccaggctggaatccttgagggtggcattatcaaatgaggaaatggttcctttcatttttcatctgaagactcagacagcaaacatgttatctggccctataagcaccccgatgcttctgtga

SEQ ID NO: 6745 - DNA, 665 bp, synthetic construct
  misc_feature 1..665: note = Synthetic polypeptide
  source 1..665: mol_type = other DNA
tgctaaggaatgaatgtttgtgccctccttgtccccaaattcagatgctgaagccccaattctcaatacgatggtatttggaaatggggcttttgagaaggaagtatggttagataatgttatgagggtggggcctaggtctgatgggattagtggcgttataagcagagacatcagagaactcgttctctctctccccacccacaggcactggggaagggccacatgaccacacagtgaaaaggtggctgcctacaagctgagagatgaggcctcggaatgaaacctgcctggctagtgttttgatcttggattttcctgcctccagaacagaaaataaatttctgttgtttaagtcctggtctacggaattttgctatggtgtagggagtgaagtctcagataagaggacctgtgtgagcctcactacccagcgactgccggttagcagaatcaagacctacaccatcacggaaggctccttgagagcagtaatttttattaccaaacgtggcctaaaagtctgtgctgatccacaagccacatgggtgagagacgtggtcaggagcatggacaggaaatccaacaccagaaataacatgatccagaccaagccaacaggaacccagcaatcgaccaatacagctgtgactctgactggctag

SEQ ID NO: 6746 - DNA, 750 bp, synthetic construct; identical to SEQ ID NO: 489
  misc_feature 1..750: note = Synthetic polypeptide
  source 1..750: mol_type = other DNA

SEQ ID NO: 6747 - DNA, 387 bp, synthetic construct
  misc_feature 1..387: note = Synthetic polypeptide
  source 1..387: mol_type = other DNA
cactcttacttgtctttttgatgacgtgtctgtctccccaccagacctgggagcgtctcgagggcagggtccgggtctgactcgtctctatgtcccccacgcccggcccagggctggccacagacaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggtga

SEQ ID NO: 6748 - DNA, 408 bp, synthetic construct
  misc_feature 1..408: note = Synthetic polypeptide
  source 1..408: mol_type = other DNA
cactcttacttgtctttttgatgacgtgtctgtctccccaccagacctgggagcgtctcgagggcagggtccgggtctgactcgtctctatgtcccccacgcccggcccagggctggccacagacaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactga

SEQ ID NO: 6749 - DNA, 360 bp, synthetic construct
  misc_feature 1..360: note = Synthetic polypeptide
  source 1..360: mol_type = other DNA
cactcttacttgtctttttgatgacgtgtctgtctccccaccagacctgggagcgtctcgagggcagggtccgggtctgactcgtctctatgtcccccacgcccggcccagggctggccacagacaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccat

SEQ ID NO: 6750 - DNA, 334 bp, synthetic construct
  misc_feature 1..334: note = Synthetic polypeptide
  source 1..334: mol_type = other DNA
cactcttacttgtctttttgatgacgtgtctgtctccccaccagacctgggagcgtctcgagggcagggtccgggtctgactcgtctctatgtcccccacgcccggcccagggctggccacagacaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttga

SEQ ID NO: 6751 - DNA, 237 bp, synthetic construct
  misc_feature 1..237: note = Synthetic polypeptide
  source 1..237: mol_type = other DNA
cactcttacttgtctttttgatgacgtgtctgtctccccaccagacctgggagcgtctcgagggcagggtccgggtctgactcgtctctatgtcccccacgcccggcccagggctggccacagacaatggtggatgtgatctttgctgatgtggcccagccagaccagacccggattgtggccctgaatgcccacaccttcctgcgtaatggaggacactttgtgatttccattaag

SEQ ID NO: 6752 - DNA, 2120 bp, synthetic construct
  misc_feature 1..2120: note = Synthetic polypeptide
  source 1..2120: mol_type = other DNA
tctccctctccctctccccatggtctccctctccctctccccacggtctccctctccctctctttccacggtctccctctcatgctgagccgaagctggactgtactgctgccatctcggctcactgcaacctccctgcctgattctcctgactcagcctgccgagtacctgcgattgcaggctggcgccgccacgcctgactggttttggtggagaccgggtttcgctatgttggccaggccggtctccaacccctaactgcaagtgatccgccagcctcggcctcccgaggtgcggggattgcagacggagtctcgttcactcagtgctcaatggtgcccaggctggagtgcagtggcgtgatctcggctcgctacaacctccacctcccagccgcctgccttggcctcccaaagtgccgagattgcagaaagattgcagcctctgcccggccaccaccccgtctgggaagtgaggagcgtctctgcctggccgcccatcatctgggatgtgaggagcccctctgcctggctgcccagtctggaaagtgaggagcgtctccgcccggccgccatcccacctaggaagtgaggagcacctcttcccggccgccatcacatctaggaagtgaggagcgtctctgcccggccgcccatcgtctgagatgtggggagcgcctctgccctgccgccccgtctgggatgtgaggagcacctctgcccggccgcgaccctgtctgggaggaaacttcatggtgttatggtcaacttgccgcacaaccgtgttcaaatctgtcaccaacaggttcattaaaaacctggcctgctcggggatttgtgccagcctggtctgtgtgcccttcgacatcatcctcagcaccagtcctcactgttgctggtggatctacaccatgctcttctgcaaggtcgtcaaatttttgcacaaagtattctgctctgtgaccatcctcagcttccctgctattgctttggacaggtactactcagtcctctatccactggagaggaaaatatctgatgccaagtcccgtgaactggtgatgtacatctgggcccatgcagtggtggccagtgtccctgtgtttgcagtaaccaatgtggctgacatctatgccacgtccacctgcacggaagtctggagcaactccttgggccacctggtgtacgttctggtgtataacatcaccacggtcattgtgcctgtggtggtggtgttcctcttcttgatactgatccgacgggccctgagtgccagccagaagaagaaggtcatcatagcagcgctccggaccccacagaacaccatctctattccctatgcctcccagcgggaggccgagctgcacgccaccctgctctccatggtgatggtcttcatcttgtgtagcgtgccctatgccaccctggtcgtctaccagactgtgctcaatgtccctgacacttccgtcttcttgctgctcactgctgtttggctgcccaaagtctccctgctggcaaaccctgttctctttcttactgtgaacaaatctgtccgcaagtgcttgatagggaccctggtgcaactacaccaccggtacagtcgccgtaatgtggtcagtacagggagtggcatggctgaggccagcctggaacccagcatacgctcgggtagccagctcctggagatgttccacattgggcagcagcagatctttaagcccacagaggatgaggaagagagtgaggccaagtacattggctcagctgacttccaggccaaggagatatttagcacctgcctggagggagagcaggggccacagtttgcgccctctgccccacccctgagcacagtggactctgtatcccaggtggcaccggcagcccctgtggaacctgaaacattccctgataagtattccctgcagtttggctttgggccttttgagttgcctcctcagtggctctcagagacccgaaacagcaagaagcggctgcttccccccttgggcaacaccccagaagagctgatccagacaaaggtgcccaaggtaggcagggtggagcggaagatgagcagaaacaataaagtgagcatttttccaaaggtggattcctag

SEQ ID NO: 6753 - DNA, 2725 bp, synthetic construct
  misc_feature 1..2725: note = Synthetic polypeptide
  source 1..2725: mol_type = other DNA
tttggtgccgtgactcagatcaggggacctcccttgggagataaatcccctgtcctcctgctctttgctctgtgagaaagatccacctacgacctcaggtcctcagaccgaccagcccaagaaacatctcaccaatttcaaatctggtaagtggcctctttttactctcttctccagcttccctcactatccctcaacctctttctcctttcaatcttggcgccacacttcaatctctcccttctcttaatttcaattcctttcattttctggtagagagagacaaaagagacacgttttatccatggacccaaaactccggtgctggtcacggactgggaaggcagccttcccttggtgtttaatcattgcagagatgcctgattattcacccacgtttcaaaggtgtcagaccacgcagggacgcctgccttggtccttcacccttagcagcaagtcccgcttttctggggaagaggcaagtaccccaatcccttctctccttgtctctaccccttctctgcttttctgggggagggacaagtacccctcaactgcttctccttcacccttagcggcaagtcccgcttttctagggggcaagaacccccaatcccttatttccacaccccaacctcttatctctgtgccccaattccttatttccatgccccaaccctttctctgcttttctggagggcaagaaacccccaccccttctccgtgtctctactcttttctctggacttgcctccttcactatgggcaagcttccaccttccattcctccttcttctcccttagcctatattcttaagaacttaaaacctcttcaactctcacctgacctaaaatctgagcatcttattttcttctgcaatgcgcttgaccccaatacaaactcgacagtagttccaaatagccggaaaatggcactttgaatttttccatcctacaagatctaaataatccttgtcataaaatgggcaaatggtctgaggtgcctgacgtccaggcattcttttacacatcagtcccttcctagtctctgtgcccagtgcaactcgtcccaaatcttccttctttcccccctccgcctgtcccctcagtcccaaccccaagcgttgctgagtctttctaatcttccttttctacagacccatctgacccctcccctcctcgccaggccaagctaggtcccaattcttcctcagcctccgctcctctaccctgtaatctttttatcgcctcccctcctcacacctggtccggcttacagtttctttctgtgactagccctcccccacctgcccagcaatttactcttaaaaaggtggctggagccaaaggcatagtcaaggttaatgctcctttttctttatcccaaatcagaagcgtttaggctcttttttatcaaatataaaaacccagcccagttcatggctcgttcggcagcaatcctgagacgttttacagccctagaccctaaaaggtcaaaaggccatcttattctcaatatacattttattacccaatctgctcctgacattaaataaaactccaaaaattagaatctggccctcaaaccccacaacaggacttaattaacctcaccttcaaggtgtacaataataaaaaaaaaaattgcaattccttgcctccactgtgagacaaaccccagccacatctccagcacacaagaacttccaaacgcctgaaccgcagcggccaggcgttcctccagaacctcctcccccaggagcttgctacaagtgccagaaatctgaccaccaggccaaggaatgcctgcagcccaggattcctcctaagccatgtcccatctgtgcgggaccacactggaaatcggactgttcaactcacctggcagccactcccagagcccctggaactctggcccaaggctctctgactgactccttcttggcttagcggctgaagattgatgctgcctcattgcctcagaagccccatagaccatcacggacgccaagcttccggaagtggttacctggaaggaaaggagctgcagaacttgatccaggagctccagcaggcgcgaaagaaggctggattggagttatcacctgaaatgaaaacttttgtggatcagtatgggcaaagagatgatggaaaaataggaattgtagagttggctcacgtattacccacagaagagaatttcctgctgctcttccgatgccagcagctgaagtcctgtgaggaattcatgaagacatggagaaaatatgatactgaccacagtggcttcatagaaactgaggagcttaagaactttctaaaggacctgctagaaaaagcaaacaagactgttgatgacacaaaattagccgagtatacagacctaatgctgaaactatttgattcaaataatgatgggaagctggaattaactgagatggccaggttactaccagtgcaggagaattttcttcttaaattccagggaatcaaaatgtgtgggaaagagttcaataaggcttttgagctgtatgatcaggacggcaatggatacatagatgaaaatgaactggatgctttactgaaggatctgtgcgagaagaataaacaggatctggatattaataatattacaacatacaagaagaacataatggctttgtcggatggagggaagctgtaccgaacggatcttgctcttattctctgtgctggggataactag

SEQ ID NO: 6754 - DNA, 426 bp, synthetic construct
  misc_feature 1..426: note = Synthetic polypeptide
  source 1..426: mol_type = other DNA
cactttagaaggctgaggcaagtggatcacttgagttgtcctgctgtccatgctatgcctggtattggcccattggcccaaacgcctgttctctggagagctgatctacatcgcagcggctgtgttgctgctggtgctcattgtgggattcactttcaccgtctggagacagccccagagcaacactcctctttacttcaaggtccccctgttgcctgttctcctctggtcagcatctctgcacatgtttacctgatgatgcagatgaccactgagacctgggcccaatgtggagtctggatgttgattggatttgctatgtattttggatatgggatcccacacagcttggagaacaatcaacagccaccagcgtcaagctcccaaactcctcatgaaaacatccctagtcccttgctgaattag

SEQ ID NO: 6755 - DNA, 1286 bp, synthetic construct
  misc_feature 1..1286: note = Synthetic polypeptide
  source 1..1286: mol_type = other DNA
attagattgtctctaggtaattggagactttaataagggctgtggtaggtgttggaagcatctactggaacaatttccagatcaaagtgaactttgctgtgctgctggggatgcagctgcaagccttcatcatcatgtgtttttctgtgggtgcagacctggactctcctgaggaaaccccagcccggccccagacactccttggcctcctcctggggcctgtttaagctgctcagttttcatgagccagctctcagatctggctcgagaccaccatggctaaggtggaaggggctgccgcccagcttcccagcctcaacaaccgactcagctatgctgtccgcaaggtccacaccattcggggcctgattgctcgaaagcttgcccttgctcagctgcgccaggagagctgtcccctaccaccaccggtcacagacgtgagccttgagttgcagcagttgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagggccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttacgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctccaatccccagatgagcagctaa

SEQ ID NO: 6756 - DNA, 503 bp, synthetic construct; identical to SEQ ID NO: 493
  misc_feature 1..503: note = Synthetic polypeptide
  source 1..503: mol_type = other DNA

SEQ ID NO: 6757 - DNA, 476 bp, synthetic construct; identical to SEQ ID NO: 495
  misc_feature 1..476: note = Synthetic polypeptide
  source 1..476: mol_type = other DNA

SEQ ID NO: 6758 - DNA, 539 bp, synthetic construct; identical to SEQ ID NO: 496
  misc_feature 1..539: note = Synthetic polypeptide
  source 1..539: mol_type = other DNA

SEQ ID NO: 6759 - DNA, 206 bp, synthetic construct
  misc_feature 1..206: note = Synthetic polypeptide
  source 1..206: mol_type = other DNA
gggggaggagccaagatggccgaataggaacagctccggtctacagctcccagcgtgagcagaagacggcgatttctgcatttccatctgagacaaagactacaagaatttcaacagtaacagcaacaacagcaacaacaactttgatgatgactactgcttcgatgtcttcgatggctcctacccccgtttctcccactggttga

SEQ ID NO: 6760 - DNA, 1443 bp, synthetic construct
  misc_feature 1..1443: note = Synthetic polypeptide
  source 1..1443: mol_type = other DNA
ggcctgggaggggcccggccggcggggctgagcctgtgcgtcctggggtgaggcctgggaggggcccggccggcggggctgagcctgtgcgtcctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtga

SEQ ID NO: 6761 - DNA, 984 bp, synthetic construct
  misc_feature 1..984: note = Synthetic polypeptide
  source 1..984: mol_type = other DNA
ggcctgggaggggcccggccggcggggctgagcctgtgcgtcctggggtgaggcctgggaggggcccggccggcggggctgagcctgtgcgtcctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggccgctga

SEQ ID NO: 6762 - DNA, 1032 bp, synthetic construct
  misc_feature 1..1032: note = Synthetic polypeptide
  source 1..1032: mol_type = other DNA
ggcctgggaggggcccggccggcggggctgagcctgtgcgtcctggggtgaggcctgggaggggcccggccggcggggctgagcctgtgcgtcctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgagtgcgcgcgcaggatgaagaagtgcatcaggtgccaggtggtcgtcagcaagaaactgcgcccagacggctctga

SEQ ID NO: 6763 - DNA, 1636 bp, synthetic construct; identical to SEQ ID NO: 531
  misc_feature 1..1636: note = Synthetic polypeptide
  source 1..1636: mol_type = other DNA

SEQ ID NO: 6764 - DNA, 835 bp, synthetic construct
  misc_feature 1..835: note = Synthetic polypeptide
  source 1..835: mol_type = other DNA
tgactgtccctacctggctcgcaagctgacccttgccatccccatcatcgctgccatcctcttcttcttcgtcatgagctgcctgctgcagacaagcttcaccgaccctgggatcctgccccgggccactgtctgtgaagcagccgccctggagaaacagatcgacaacacaggcagttctacataccggccaccccctcggacccgggaggtgctgatcaacgggcagatggtgaagctgaagtactgcttcacctgcaagatgttccggccaccccgaacctcacactgcagtgtctgcgacaactgtgtggaacgatttgaccatcactgcccctgggtgggcaactgtgtggggagacggaactatcgcttcttctacgcgtttattctctccctctcattcctgacggccttcatcttcgcctgtgtggtcacccacctgacgttgcgcgctcagggaagcaacttcctctccactctgaaggagacaccagcaagcgtgctggagttggtgatctgcttcttctccatctggtccattctgggcctctcagggtttcacacgtacctcgtcgcctccaacctgactactaatgaagacatcaaaggctcgtggtccagcaagaggggcggtgaggcctctgtcaacccctacagccataaaagtattatcaccaactgctgtgctgtgctctgtggccccctacctcccagcctaattgaccggaggggatttgtgcagtccgacaccgtgttgccctcacccatcagaagcgatgagccagcctgcagagccaagcctgatgccagcatggtaggaggccacccctga

SEQ ID NO: 6765 - DNA, 839 bp, synthetic construct
  misc_feature 1..839: note = Synthetic polypeptide
  source 1..839: mol_type = other DNA
tgcagtcagtagaatgatggccccacagatgtccacatctcactggctggaacctgtgaatatgttgggttgtatggcaaaggaaactaaggctgcagatggaactaaggttatttacctttagtgaattccatcttctgaaaacaatgcttttgtgggtcttcttgcaactgaactacaagattcaggcaattccgacttatgaaaccgtgatgacattttttaagagctttcctgagaactgttgctttctggaccgggacataggacggagcttgaggccgctcttcctctgcttgcgtctgcacggcatcaccaaaggcaaggatctggaggtgctgcggcaccttaacttcttcccagagtcatggctcgaccaggttacagtcaaccattaccacgcactggagaatgggggcgacatggtccacctgaaagatcttaacacccaggctgtgagatttgggctgctctttaaccaggagaatacaacttattcgaaaacgattgctctatatggattcttctttaagataaagggactcaaacatgatactacctcttatagtttttacatgcagagaataaagcacacagacctggaatctccctctgcggtctacgagcacaaccacgtcagcctgcgagcggcacgcctggtgaagtatgagatcagagcagaggccctggttgacggcaagtggcaggagttcaggacaaaccagatcaagcagaagtttgggttgaccacgtcatcctgcaaaagccataccttgaaaatccaaactgtgggcatcccaatctatgtaagttttgcattcatcttcccagcatcttga

SEQ ID NO: 6766 - DNA, 226 bp, synthetic construct
  misc_feature 1..226: note = Synthetic polypeptide
  source 1..226: mol_type = other DNA
ccatcaccaagcggtgagactatcacctatcgccaagtggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtg

SEQ ID NO: 6767 - DNA, 394 bp, synthetic construct
  misc_feature 1..394: note = Synthetic polypeptide
  source 1..394: mol_type = other DNA
ccatcaccaagcggtgagactatcacctatcgccaagtggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6768 - DNA, 454 bp, synthetic construct
  misc_feature 1..454: note = Synthetic polypeptide
  source 1..454: mol_type = other DNA
ccatcaccaagcggtgagactatcacctatcgccaagtggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtggtgaggattggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctga

SEQ ID NO: 6769 - DNA, 346 bp, synthetic construct
  misc_feature 1..346: note = Synthetic polypeptide
  source 1..346: mol_type = other DNA
ccatcaccaagcggtgagactatcacctatcgccaagtggaggggtgctgtcatcctggtctcttccattgcagcttataatccagtagtggcgctgggtgtctacaatgtcagcaagacagcgctgctgggtctcactagaacactggcattggagctggcccccaaggacatccggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6770 - DNA, 337 bp, synthetic construct
  misc_feature 1..337: note = Synthetic polypeptide
  source 1..337: mol_type = other DNA
ccatcaccaagcggtgagactatcacctatcgccaagtggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggcaagtggggtttggagatttggtggtccatgtgtggctaggcaggggcagttga

SEQ ID NO: 6771 - DNA, 1328 bp, synthetic construct; identical to SEQ ID NO: 532
  misc_feature 1..1328: note = Synthetic polypeptide
  source 1..1328: mol_type = other DNA

SEQ ID NO: 6772 - DNA, 7501 bp, synthetic construct; identical to SEQ ID NO: 557
  misc_feature 1..7501: note = Synthetic polypeptide
  source 1..7501: mol_type = other DNA

SEQ ID NO: 6773 - DNA, 7492 bp, synthetic construct; identical to SEQ ID NO: 558
  misc_feature 1..7492: note = Synthetic polypeptide
  source 1..7492: mol_type = other DNA

SEQ ID NO: 6774 - DNA, 373 bp, synthetic construct; identical to SEQ ID NO: 559
  misc_feature 1..373: note = Synthetic polypeptide
  source 1..373: mol_type = other DNA

SEQ ID NO: 6775 - DNA, 337 bp, synthetic construct; identical to SEQ ID NO: 560
  misc_feature 1..337: note = Synthetic polypeptide
  source 1..337: mol_type = other DNA

SEQ ID NO: 6776 - DNA, 301 bp, synthetic construct; identical to SEQ ID NO: 561
  misc_feature 1..301: note = Synthetic polypeptide
  source 1..301: mol_type = other DNA

SEQ ID NO: 6777 - DNA, 373 bp, synthetic construct; identical to SEQ ID NO: 562
  misc_feature 1..373: note = Synthetic polypeptide
  source 1..373: mol_type = other DNA

SEQ ID NO: 6778 - DNA, 442 bp, synthetic construct; identical to SEQ ID NO: 563
  misc_feature 1..442: note = Synthetic polypeptide
  source 1..442: mol_type = other DNA

SEQ ID NO: 6779 - DNA, 1276 bp, synthetic construct; identical to SEQ ID NO: 565
  misc_feature 1..1276: note = Synthetic polypeptide
  source 1..1276: mol_type = other DNA

SEQ ID NO: 6780 - DNA, 7528 bp, synthetic construct; identical to SEQ ID NO: 566
  misc_feature 1..7528: note = Synthetic polypeptide
  source 1..7528: mol_type = other DNA

SEQ ID NO: 6781 - DNA, 418 bp, synthetic construct; identical to SEQ ID NO: 567
  misc_feature 1..418: note = Synthetic polypeptide
  source 1..418: mol_type = other DNA

SEQ ID NO: 6782 - DNA, 1392 bp, synthetic construct
  misc_feature 1..1392: note = Synthetic polypeptide
  source 1..1392: mol_type = other DNA
ggcctgggaggggcccggccggcggggctgagcctgtgcgtcctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtga

SEQ ID NO: 6783 - DNA, 933 bp, synthetic construct
  misc_feature 1..933: note = Synthetic polypeptide
  source 1..933: mol_type = other DNA
ggcctgggaggggcccggccggcggggctgagcctgtgcgtcctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggccgctga

SEQ ID NO: 6784 - DNA, 981 bp, synthetic construct
  misc_feature 1..981: note = Synthetic polypeptide
  source 1..981: mol_type = other DNA
ggcctgggaggggcccggccggcggggctgagcctgtgcgtcctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgagtgcgcgcgcaggatgaagaagtgcatcaggtgccaggtggtcgtcagcaagaaactgcgcccagacggctctga

SEQ ID NO: 6785 - DNA, 1922 bp, synthetic construct
  misc_feature 1..1922: note = Synthetic polypeptide
  source 1..1922: mol_type = other DNA
cactggggtattgtcagcgcctagtaaagcacttggcatacagagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtga

SEQ ID NO: 6786 - DNA, 1997 bp, synthetic construct
  misc_feature 1..1997: note = Synthetic polypeptide
  source 1..1997: mol_type = other DNA
cactggggtattgtcagcgcctagtaaagcacttggcatacagagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcgaaaaccctgcccttcacaccagatatcctcgttggggtcccactgtggcatcatcagaagatagggggtagtccggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtga

SEQ ID NO: 6787 - DNA, 568 bp, synthetic construct
  misc_feature 1..568: note = Synthetic polypeptide
  source 1..568: mol_type = other DNA
caacatgaagcctgacacattatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtga

SEQ ID NO: 6788 - DNA, 181 bp, synthetic construct
  misc_feature 1..181: note = Synthetic polypeptide
  source 1..181: mol_type = other DNA
caacatgaagcctgacacattatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccacaagtaa

SEQ ID NO: 6789 - DNA, 367 bp, synthetic construct; identical to SEQ ID NO: 548
  misc_feature 1..367: note = Synthetic polypeptide
  source 1..367: mol_type = other DNA

SEQ ID NO: 6790 - DNA, 398 bp, synthetic construct
  misc_feature 1..398: note = Synthetic polypeptide
  source 1..398: mol_type = other DNA
ggccaggcaccgtggctcacacctgtaacccaagcactttgggaggccgaggcaggaggattgcttgagtccaggagttcaagaccagcctgagcaacatagcgaaacctcactgctacaaaaaagaagagagaaaaaaaaaaaaggctgggcatggtgtcatgtgcctgtagtcccagctgcctgggaggctgagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagccttctga

SEQ ID NO: 6791 - DNA, 391 bp, synthetic construct
  misc_feature 1..391: note = Synthetic polypeptide
  source 1..391: mol_type = other DNA
ggccaggcaccgtggctcacacctgtaacccaagcactttgggaggccgaggcaggaggattgcttgagtccaggagttcaagaccagcctgagcaacatagcgaaacctcactgctacaaaaaagaagagagaaaaaaaaaaaaggctgggcatggtgtcatgtgcctgtagtcccagctgcctgggaggctgagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagc

SEQ ID NO: 6792 - DNA, 473 bp, synthetic construct
  misc_feature 1..473: note = Synthetic polypeptide
  source 1..473: mol_type = other DNA
ggccaggcaccgtggctcacacctgtaacccaagcactttgggaggccgaggcaggaggattgcttgagtccaggagttcaagaccagcctgagcaacatagcgaaacctcactgctacaaaaaagaagagagaaaaaaaaaaaaggctgggcatggtgtcatgtgcctgtagtcccagctgcctgggaggctgagggctgaccagtttgagtatgtaatgtatggaaaagtgtacaggattgagggagatgaaacttctactgaagcagcaacacgcctgctgagattgagagctgctgagtggcagtgctccagaatcacgggatggggccttctgtttcagctctgcgtacgtgtcctatgggggcctgctcatgaggctgcagggggatgccaacaacctgcatggattcgaggtggactccagagtttatctcctgatgaagaagctagccttctgaacctcgcctga

SEQ ID NO: 6793 - DNA, 1197 bp, synthetic construct
  misc_feature 1..1197: note = Synthetic polypeptide
  source 1..1197: mol_type = other DNA
gcctggctcggtagctcacgcctgtcatcccagtgctttgggagcccgaggcgggtggatcgcttgagtccaggagtttaagaccagaccgggtgacatggcgaaaccccatctctacaaaaaatacaaaaattagccaggcctggtgatgaaagtgaagaggatgaagatgatttgttgcaaaggactgggaatttcatatccacatcaacttctcttccaagaggaatcttgaagatgaagaactgccagcatgcgaatgctgaacgtcctactgttgctcggatctcatctgtgcagttccatcccggtgcacagattgtgatggttgctggattagataatgctgtatcactatttcaggttgatgggaaaacaaatcctaaaattcagagcatctatttggaaaggtttccaatctttaaggcttgttttagtgctaatggggaagaagttttagccacgagtacccacagcaaggttctttatgtctatgacatgctggctggaaagttaattcctgtgcatcaagtgagaggtttgaaagagaagatagtgaggagctttgaagtctccccagatgggtccttcttgctcataaatggcattgctggatatttgcatttgctagcaatgaagaccaaagaactgattggaagcatgaaaattaatggaagggttgcagcatccacattctcttcagatagtaagaaagtatacgcctcttcgggggatggagaagtttatgtttgggatgtgaactcaaggaagtgccttaacagatttgttgatgaaggcagtttatatggattaagcattgccacatctaggaatggacagtatgttgcttgtggttctaattgtggagtggtaaatatatacaatcaagattcttgtctccaagaaacaaacccaaagccaataaaagctataatgaacttggttacaggtgttacttctctgaccttcaatcctactacagaaatcttggcaattgcttcagaaaaaatgaaagaagcagtcagattggttcatcttccttcctgtacagtattttcaaacttcccagtcattaaaaataagaatatttctcatgttcataccatggatttttctccgagaagtggatactttgccttggggaatgaaaagggcaaggccctgatgtataggttgcaccattactcagacttctaa

SEQ ID NO: 6794 - DNA, 708 bp, synthetic construct
  misc_feature 1..708: note = Synthetic polypeptide
  source 1..708: mol_type = other DNA
gccaaatgtggttgctcacacctgtgatctgagcactttgggaggccaaggtgagaggatcgcttaagcctaggagttcaaaaccagcctcggcaacatgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcgggtgatggacatgctgcactctatgggccccgacaccgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtga

SEQ ID NO: 6795 - DNA, 1016 bp, synthetic construct
  misc_feature 1..1016: note = Synthetic polypeptide
  source 1..1016: mol_type = other DNA
ttaggtgcacttacctaaccattccgaactgggctcggcaggatcttcgctctcttcgcctctggacagatttctgctctctcttcagctcaaacagcaacctcaagtttctggaagtgaaacaaagcttcctgagtgactcttctgtgcggattctttgtgaccacgtaacccgtagcacctgtcatctgcagaaagtggagattaaaaacgtcacccctgacaccgcgtaccgggacttctgtcttgctttcattgggaagaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaaactgtcgtcttacagaagccagttgcaaggaccttgctgctgtcttggttgtcagcaagaagctgacacacctgtgcttggccaagaaccccattggggatacaggggtgaagtttctgtgtgagggcttgagttaccctgattgtaaactgcagaccttggtgttacagcaatgcagcataaccaagcttggctgtagatatctctcagaggcgctccaagaagcctgcagcctcacaaacctggacttgagtatcaaccagatagctcgtggattgtggattctctgtcaggcattagagaatccaaactgtaacctaaaacacctacggttgaagacctatgaaactaatttggaaatcaagaagctgttggaggaagtgaaagaaaagaatcccaagctgactattgattgcaatgcttccggggcaacggcacctccgtgctgtgactttttttgctga

SEQ ID NO: 6796 - DNA, 1187 bp, synthetic construct
  misc_feature 1..1187: note = Synthetic polypeptide
  source 1..1187: mol_type = other DNA
ttaggtgcacttacctaaccattccgaactgggctcggcaggatcttcgctctcttcgcctctggacagatttctgctctctcttcagctcaaacagcaacctcaagtttctggaagtgaaacaaagcttcctgagtgactcttctgtgcggattctttgtgaccacgtaacccgtagcacctgtcatctgcagaaagtggagattaaaaacgtcacccctgacaccgcgtaccgggacttctgtcttgctttcattgggaagaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaaactgtcgtcttacagaagccagttgcaaggaccttgctgctgtcttggttgtcagcaagaagctgacacacctgtgcttggccaagaaccccattggggatacaggggtgaagtttctgtgtgagggcttgagttaccctgattgtaaactgcagaccttggtgttacagcaatgcagcataaccaagcttggctgtagatatctctcagaggcgctccaagaagcctgcagcctcacaaacctggacttgagtatcaaccagatagctcgtggattgtggattctctgtcaggcattagagaatccaaactgtaacctaaaacacctacgcctctggagctgctccctcatgcctttctattgtcagcatcttggatctgctctcctcagcaatcagaagcttgaaactctggacctgggccagaatcatttgtggaagagtggcataattaagctctttggggttctaagacaaagaactggatccttgaagatactcaggttgaagacctatgaaactaatttggaaatcaagaagctgttggaggaagtgaaagaaaagaatcccaagctgactattgattgcaatgcttccggggcaacggcacctccgtgctgtgactttttttgctga

SEQ ID NO: 6797 - DNA, 965 bp, synthetic construct
  misc_feature 1..965: note = Synthetic polypeptide
  source 1..965: mol_type = other DNA
ttaggtgcacttacctaaccattccgaactgggctcggcaggatcttcgctctcttcgcctctggacagatttctgctctctcttcagctcaaacagcaacctcaagtttctggaagtgaaacaaagcttcctgagtgactcttctgtgcggattctttgtgaccacgtaacccgtagcacctgtcatctgcagaaagtggagattaaaaacgtcacccctgacaccgcgtaccgggacttctgtcttgctttcattgggaagaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaaactgtcgtcttacagaagccagttgcaaggaccttgctgctgtcttggttgtcagcaagaagctgacacacctgtgcttggccaagaaccccattggggatacaggggtgaagtttctgtgtgagggcttgagttaccctgattgtaaactgcagaccttggtgttacagcaatgcagcataaccaagcttggctgtagatatctctcagaggcgctccaagaagcctgcagcctcacaaacctggacttgagtatcaaccagatagctcgtggattgtggattctctgtcaggcattagagaatccaaactgtaacctaaaacacctacgcatcttggatctgctctcctcagcaatcagaagcttgaaactctggacctgggccagaatcatttgtggaagagtggcataa

SEQ ID NO: 6798 - DNA, 784 bp, synthetic construct
  misc_feature 1..784: note = Synthetic polypeptide
  source 1..784: mol_type = other DNA
agttcaaccttgtggggagccctgaccccaggagagaggcaacagggttcacaccccagccgggccacgtgacacaggacatatcatgagcgtcttgttgttcatcgagcactcagtagaggtggcccatggcaaggcgtcctgcaagctctcccagatgggctacctcaggatcgctgacctgatctccagcttcctgctcatcaccatgctcttcatcatcagcctgagcctactgatcggcgtagtcaagaaccgggagaagtacctgctgcccttcctgtccctgcaaatcatggactatctcctgtgcctgctcaccctgctgggctcctacattgagctgcccgcctacctcaagttggcctcccggagccgtgctagctcctccaagttccccctgatgacgctgcagctgctggacttctgcctgagcatcctgaccctctgcagctcctacatggaagtgcccacctatctcaacttcaagtccatgaaccacatgaattacctccccagccaggaggatatgcctcataaccagttcatcaagatgatgatcatcttttccatcgccttcatcactgtccttatcttcaaggtctacatgttcaagtgcgtgtggcggtgctacagattgatcaagtgcatgaactcggtggaggagaagagaaactccaagatgctccagaaggtggtcctgccgtcctacgaggaagccctgtctttgccatcgaagaccccagaggggggcccagcaccacccccatactcagaggtgtga

SEQ ID NO: 6799 - DNA, 2287 bp, synthetic construct
  misc_feature 1..2287: note = Synthetic polypeptide
  source 1..2287: mol_type = other DNA
ctgccatcccctttatctctcttagttaatgccacccacccacaccaggctgcctcctgttttagacttggatgaaaccacacaccatgaggtgtggtaccagcttcctgaggggccagatggtggagccagatgatgcaacctggaagtgtgcgcaagttaactcaccgtgggtgaaccttgaatgaagggaaatggaaaatgagaaggagataccagtttcattccaggacctgactgtgaacttcacccaagaggaatggcagcaactggaccctgctcagaggctcctgtacagggatgtgatgctggagaactacagcaacttggtctctgtggagtctctgatgtccaaagatcttggtccaagttctgtaatttcccattaacagggtatcatgttagcaaaccagatgtgattttcaaattggagcaaggagaagagccatggatagtggaggaattctcaaatcagaactacccagacattgatgatgccttagagaagaacaaggaaatccaagataaacatttgacacaaactgtattcttcagcaacaaaacactgattacagaaagagagaatgtatttgggaaaacacttaatctgggcatgaatagtgttccctcaagaaaaatgccctataaatgtaatccaggaggaaacagtttgaaaactaattcagaagtaattgttgcaaagaaaagcaaagaaaacagaaagattcctgatggatacagtggatttgggaagcatgagaaaagtcatttgggaatgaaaaaatacagatacaatccaatgaggaaagccagcaatcaaaacgaaaatcttattctgcaccagaacattcagattttgaaacaaccgtttgactataataaatgtgggaaaaccttcttcaagagggcaattctcattacacaaaaggggagacagactgaaaggaaaccaaatgaatgtaatgaatgtaggaaaaccttttctaagagatctaccctcattgtacatcagagaattcatacaggggagaaaccgtatgtttgtagtgattgtaggaaaacttttcgtgtgaagacaagcctcactcgacaccgaagaattcatactggagagagaccctatgaatgcagtgaatgcaggaaaaccttcattgacaaatctgcccttattgtacaccagaaaattcatggaggggagaaatcctatgagtgtaatgaatgtggaaagaccttttttcggaagtcagccctggctgaacatttcaggtcacacacaggggagaagccttacgaatgcaaggaatgtggaaatgccttcagcaagaaatcgtatcttgttgtacatcaaagaactcacagaggagagaagccaaatgaatgtaaggaatgtgggaaaaccttcttctgtcagtcagcccttactgcgcatcagagaattcacacaggggaaaaaccctatgaatgtagtgaatgtgagaaaaccttcttttgtcaatctgccctcaatgtgcatcgaagaagtcatacaggagagaagccctatgaatgcagtcaatgtggaaaatttttatgtacgaaatcagccctcattgcacatcagataactcatagaggaaagaagtcttatgaatgtaatgaatgtgggaaatttttctgccataagtcaacactcactatacatcagagaacacacacaggagagaaacatggtgtgtttaataaatgtggtagaatctccattgtgaagtcaaactgcagtcagtgtaagagaatgaacacaaaggagaatctttatgagtgtagtgaacatgggcatgccgtcagcaaaaactcacacctcattgtacatcagagaactatatgggagagaccatatgaatgcaatgaatgtgggagaacctactgcaggaagtcagccctgactcaccatcagagaacacacacaggacagagaccctatgagtgtaatgaatgtgggaaaaccttctgtcagaagttctcctttgttgaacatcagcgaactcacactggggagaaaccatatgaatgtaatgaatgtgggaaatccttctgccataagtcagccttcagagtccatagaagaattcacacaggagagaaaccatatgaatgtaatcaatgtgggaaaacctaccgtcgcctgtggactctcactgaacatcagaaaatacacacaggagagaaaccttatgaatgtaacaaatgtgagaaaacatttcgccacaaatcaaactttcttttacatcagaaatcccacaaggaataa

SEQ ID NO: 6800 - DNA, 2234 bp, synthetic construct
  misc_feature 1..2234: note = Synthetic polypeptide
  source 1..2234: mol_type = other DNA
ctgccatcccctttatctctcttagttaatgccacccacccacaccaggctgcctcctgttttagacttggatgaaaccacacaccatgaggtgtggtaccagcttcctgaggggccagatggtggagccagatgatgcaacctggaagtgtgcgcaagttaactcaccgtgggtgaaccttgaatgaagggaaatggaaaatgagaaggagataccagtttcattccaggacctgactgtgaacttcacccaagaggaatggcagcaactggaccctgctcagaggctcctgtacagggatgtgatgctggagaactacagcaacttggtctctgtggggtatcatgttagcaaaccagatgtgattttcaaattggagcaaggagaagagccatggatagtggaggaattctcaaatcagaactacccagacattgatgatgccttagagaagaacaaggaaatccaagataaacatttgacacaaactgtattcttcagcaacaaaacactgattacagaaagagagaatgtatttgggaaaacacttaatctgggcatgaatagtgttccctcaagaaaaatgccctataaatgtaatccaggaggaaacagtttgaaaactaattcagaagtaattgttgcaaagaaaagcaaagaaaacagaaagattcctgatggatacagtggatttgggaagcatgagaaaagtcatttgggaatgaaaaaatacagatacaatccaatgaggaaagccagcaatcaaaacgaaaatcttattctgcaccagaacattcagattttgaaacaaccgtttgactataataaatgtgggaaaaccttcttcaagagggcaattctcattacacaaaaggggagacagactgaaaggaaaccaaatgaatgtaatgaatgtaggaaaaccttttctaagagatctaccctcattgtacatcagagaattcatacaggggagaaaccgtatgtttgtagtgattgtaggaaaacttttcgtgtgaagacaagcctcactcgacaccgaagaattcatactggagagagaccctatgaatgcagtgaatgcaggaaaaccttcattgacaaatctgcccttattgtacaccagaaaattcatggaggggagaaatcctatgagtgtaatgaatgtggaaagaccttttttcggaagtcagccctggctgaacatttcaggtcacacacaggggagaagccttacgaatgcaaggaatgtggaaatgccttcagcaagaaatcgtatcttgttgtacatcaaagaactcacagaggagagaagccaaatgaatgtaaggaatgtgggaaaaccttcttctgtcagtcagcccttactgcgcatcagagaattcacacaggggaaaaaccctatgaatgtagtgaatgtgagaaaaccttcttttgtcaatctgccctcaatgtgcatcgaagaagtcatacaggagagaagccctatgaatgcagtcaatgtggaaaatttttatgtacgaaatcagccctcattgcacatcagataactcatagaggaaagaagtcttatgaatgtaatgaatgtgggaaatttttctgccataagtcaacactcactatacatcagagaacacacacaggagagaaacatggtgtgtttaataaatgtggtagaatctccattgtgaagtcaaactgcagtcagtgtaagagaatgaacacaaaggagaatctttatgagtgtagtgaacatgggcatgccgtcagcaaaaactcacacctcattgtacatcagagaactatatgggagagaccatatgaatgcaatgaatgtgggagaacctactgcaggaagtcagccctgactcaccatcagagaacacacacaggacagagaccctatgagtgtaatgaatgtgggaaaaccttctgtcagaagttctcctttgttgaacatcagcgaactcacactggggagaaaccatatgaatgtaatgaatgtgggaaatccttctgccataagtcagccttcagagtccatagaagaattcacacaggagagaaaccatatgaatgtaatcaatgtgggaaaacctaccgtcgcctgtggactctcactgaacatcagaaaatacacacaggagagaaaccttatgaatgtaacaaatgtgagaaaacatttcgccacaaatcaaactttcttttacatcagaaatcccacaaggaataa

SEQ ID NO: 6801 - DNA, 1327 bp, synthetic construct
  misc_feature 1..1327: note = Synthetic polypeptide
  source 1..1327: mol_type = other DNA
ctgatctatcgctacctgatgtcctttcctattgctttctgctttcactcacctggctctaataatatggattccttgcaacgtgacaggcacaaatctgactcctggcctttgcacttgctattcctttgtcctggattgctcttttcccagatatatgaatgtggtttactctgtcacctctctgaagtcctggctcaaatgtcatgttttaccttctcagggaggacttgcctggccaccgtgttgaagagactgtcctttcctacatagatgggctctccttccccaccgtctttctctccttagtgcttacgaccagccatcactctatatattatgcctttttgtcttgtttattgtttgtcctctttcccctccctgctacaccctcgaattaatgcacacagggcaggggcttttgtttggttcactcatagtcatgtgtccccagcagctagtttgttgcctggcatgaggaatattaatgcaaaaatgccgtaataaagtcatgaaaaactatggaagatactatattgctgcgtcctatgtaaagtacttggagtctgcaggtgcgagagttgtaccagtaaggctggatcttacagagaaagactatgaaatacttttcaaatctattaatggaatccttttccctggaggaagtgttgacctcagacgctcagattatgctaaagtggccaaaatattttataacttgtccatacagagttttgatgatggagactattttcctgtgtggggcacatgccttggatttgaagagctttcactgctgattagtggagagtgcttattaactgccacagatactgttgacgtggcaatgccgctgaacttcactggaggtcaattgcacagcagaatgttccagaattttcctactgagttgttgctgtcattagcagtagaacctctgactgccaatttccataagtggagcctctccgtgaagaattttacaatgaatgaaaagttaaagaagtttttcaatgtcttaactacaaatacagatggcaagattgagtttatttcaacaatggaaggatataagtatccagtatatggtgtccagtggcatccagagaaagcaccttatgagtggaagaatttggatggcatttcccatgcacctaatgctgtgaaaaccgcattttatttagcagagttttttgttaatgaagctcggaaaaacaaccatcattttaaatctgaatctgaagaggagaaagcattgatttatcagttcagtccaatttatactggaaatatttcttcatttcagcaatgttacatatttgattga

SEQ ID NO: 6802 - DNA, 294 bp, synthetic construct
  misc_feature 1..294: note = Synthetic polypeptide
  source 1..294: mol_type = other DNA
acagtgtttaaaaacaagagtttggccccagcctgctccagatctccccctcactaactgtgggatcctgggatcatctttgagcctcattttcctcacgggctggcaaaggaggaggtgagccggcaggagctgaggcagcgggtgcgcatggctgacaacgaggtcatggacgcctttcgcaagatcatggctgcccggcagaagaagcggactcccaccaagaaagaaaaggaccaggcctggaagactctgaaggagcgtgagagcatcctgaagctgctggatgggtag

SEQ ID NO: 6803 - DNA, 132 bp, synthetic construct
  misc_feature 1..132: note = Synthetic polypeptide
  source 1..132: mol_type = other DNA
ggccagtccctctccaagatcctggatgtggccagtttggaggtgctgaacgaggttaaccgaaggtccctgaagaagctggccagccaggccgactccacggagcaggtggacgacaccatcctgacatga

SEQ ID NO: 6804 - DNA, 625 bp, synthetic construct
  misc_feature 1..625: note = Synthetic polypeptide
  source 1..625: mol_type = other DNA
aatatcacctgggagtgtgttggaaatggacaatctcagcgctcatcccagacctactgaatcagaatcagcactttaacacagtccctaagtgatgtaacacctggagaccgactccctggaccctgagaagctattgcaatgcccctatgacaaaaaccatcaaatcagggcttgcaggtttccttatcatcttatcaagtgcagaaagaatcatcctgatgttgcaagcaaattggctacttgtcccttcaatgctcgccaccaggttcctcgagctgaaattagtcatcatatctcaagctgtgatgacagaagttgtattgagcaagatgttgtcaaccaaaccaggagccttagacaagagactctggctgagagcacttggcagtgccctccttgcgatgaagactgggataaagatttgtgggagcagaccagcaccccatttgtctggggcacaactcactactctgacaacaacagccctgcgagcaacatagttacagaacataagaataacctggcttcaggcatgcgagttcccaaatctctgccgtatgttctgccatggaaaaacaattcagattctcttgatttcagtctgtgctactgtttgagctaa

SEQ ID NO: 6805 - DNA, 598 bp, synthetic construct
  misc_feature 1..598: note = Synthetic polypeptide
  source 1..598: mol_type = other DNA
aatatcacctgggagtgtgttggaaatggacaatctcagcgctcatcccagacctactgaatcagaatcagcactttaacacagtccctaagtgatgtaacacctggagaccgactccctggaccctgagaagctattgcaatgcccctatgacaaaaaccatcaaatcagggcttgcaggtttccttatcatcttatcaagtgcagaaagaatcatcctgatgttgcaagcaaattggctacttgtcccttcaatgctcgccaccaggttcctcgagctgaaattagtcatcatatctcaagctgtgatgacagaagttgtattgagcaagatgttgtcaaccaaaccaggagccttagacaagagactctggctgagagcacttggcagtgccctccttgcgatgaagactgggataaagatttgtgggagcagaccagcaccccatttgtctggggcacaactcactactctgacaacaacagccctgcgagcaacatagttacagaacataagaataacctggcttcaggcatgcgagttcccaaatctctgccgtatgttctgccatggaaaaacaatggaaatgcacagtaa

SEQ ID NO: 6806 - DNA, 2534 bp, synthetic construct; identical to SEQ ID NO: 586
  misc_feature 1..2534: note = Synthetic polypeptide
  source 1..2534: mol_type = other DNA

SEQ ID NO: 6807 - DNA, 1716 bp, synthetic construct
  misc_feature 1..1716: note = Synthetic polypeptide
  source 1..1716: mol_type = other DNA
tagtaggtaagagtggactctggagccagcttgtctccctctggatcctagctctgctgcttactagctgtgttattttgggtttttcatttgttgcaagcctactcagactccaaacacggaacgaattcagacttccagcacgagctgactgacatcactgtttgtaccaaagccaaactctggctggccaagaggcaaaatccatgtttggtgaccagagctgtatatattgatattctcttcctattgacttgctgcctcaacagatctgcaaaggacaaccagccagttctggagagtcttggcttctgggaggaagtcagagggattatctcaggatcagagctgataacgggattcccttgggccttcaaggtgccaggcctgccccagtacctccagagcctcaccagactagccattgctgcagtgtgggccgcggcagccaagagtggagagcgggagacgaatgtccccatctctttctctcagctgttagaatctgccttccctgaagtgcgctcactaacactggaagccctcttggaaaagttcttagcagcagcctctggacttggagagaagggcgtgccacccttgctgtgcaacatgggagagaagttcttattgttggccatgaaggaaaatcacccagaatgcttctgcaagatactgaaaattctccactgcatggaccctggtgagtggcttccccagacggagcactgtgtccatctgaccccaaaggagttcttgatctggacgatggatattgcttccaatgaaagatctgaaattcagagtgtagctctgagacttgcttccaaagtcatttcccaccacatgcagacatgtgtggagaacagggaattgatagctgctgagctgaagcagtgggttcagctggtcatcttgtcatgtgaagaccatcttcctacagagtctaggctggccgtcgttgaagtcctcaccagtactacaccacttttcctcaccaacccccatcctattcttgagttgcaggatacacttgctctctggaagtgtgtccttacccttctgcagagtgaggagcaagctgttagagatgcagccacggaaaccgtgacaactgccatgtcacaagaaaatacctgccagtcaacagagtttgccttctgccaggtggatgcctccatcgctctggccctggccctggccgtcctgtgtgatctgctccagcagtgggaccagttggcccctggactgcccatcctgctgggatggctgttgggagagagtgatgacctcgtggcctgtgtggagagcatgcatcaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgctctgtcaccttcaaaggatggtgtcagagcagtgccacctcctgtctcagttcttcagagagcttccaccagctgctgagtttgtgaagacagtggagttcacaagactacgcattcaagaggaaaggactttggcttgcttgaggctgctggcctttttggaaggaaaggaaggggaagacaccctagttctcagtgtttgggactcttatgcagaatcgaggcagttaactcttccaagaacagaagcggcatgttga

SEQ ID NO: 6808 - DNA, 379 bp, synthetic construct
  misc_feature 1..379: note = Synthetic polypeptide
  source 1..379: mol_type = other DNA
ctcaagaccttctcatggcttttagtgcaaagtccaaattcttcaggcctttgccaaccccgaggatgccctgagacacggaggcccccagtattgcaggagcgaccccgacgtggaacgctgcctcagggcccaccggaacgacatggagaccatctaccccttccttttcctgggcttcgtctactcctttctgggtcctaacccttttgtcgcctggatgcacttcctggtcttcctcgtgggccgtgtggcacacaccgtggcctacctggggaagctgcgggcacccatccgctccgtgacctacaccctggcccagctcccctgcgcctccatggctctgcagatcctctgggaagcggcccgccacctgtga

SEQ ID NO: 6809 - DNA, 586 bp, synthetic construct
  misc_feature 1..586: note = Synthetic polypeptide
  source 1..586: mol_type = other DNA
ggctgggcatatggtggctcacgcctggaatcctagcacttggagaggctgaaacggcatcacttgagcccaggagtttgagatcagcctagggaacatagcaagactccattgctacaaaaaaataaaataaaataagtagctggtggtgtctatcgaagatccctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaa

SEQ ID NO: 6810 - DNA, 1571 bp, synthetic construct
  misc_feature 1..1571: note = Synthetic polypeptide
  source 1..1571: mol_type = other DNA
ccagacataaggagggaactgataagcctaaatggtaaattgaagaaggtaaagctacttcttcttctaatccaagcagcccagctccagactggtacaaagattttgttacagatgctgatgctgaggttttagagcattctgggaaaatggtacttctctttgaaattcttcgaatggcagaggaaattggggataaagtccttgttttcagccagtccctcatatctctggacttgattgaagattttcttgaattagctagtagggagaagacagaagataaagataaaccccttatttataaaggtgaggggaagtggcttcgaaacattgactattaccgtttagatggttccactactgcacagtcaaggaagaagtgggctgaagaatttaatgatgaaactaatgtgagaggacgattatttatcatttctactaaagcaggatctctaggaattaatctggtagctgctaatcgagtaattatattcgacgcttcttggaatccatcttatgacatccagagtatattcagagtttatcgctttggacaaactaagcctgtttatgtatataggttcttagctcagggaaccatggaagataagatttatgatcggcaagtaactaagcagtcactgtcttttcgagttgttgatcagcagcaggtggagcgtcattttactatgaatgagcttactgaactttatacttttgagccagacttattagatgaccctaattcagaaaagaagaagaagagggatactcccatgctgccaaaggataccatacttgcagagctccttcagatacataaagaacacattgtaggataccatgaacatgattctcttttggaccacaaagaagaagaagagttgactgaagaagaaagaaaagcagcttgggctgagtatgaagcagagaagaagggactgaccatgcgtttcaacataccaactgggaccaatttaccccctgtcagtttcaactctcaaactccttatattcctttcaatttgggagccctgtcagcaatgagtaatcaacagctggaggacctcattaatcaaggaagagaaaaagttgtagaagcaacaaacagtgtgacagcagtgaggattcaacctcttgaggatataatttcagctgtatggaaggagaacatgaatctctcagaggcccaagtacaggcgttagcattaagtagacaagccagccaggagcttgatgttaaacgaagagaagcaatctacaatgatgtattgacaaaacaacagatgttaatcagctgtgttcagcgaatacttatgaacagaaggctccagcagcagtacaatcagcagcaacagcaacaaatgacttatcaacaagcaacactgggtcacctcatgatgccaaagcccccaaatttgatcatgaatccttctaactaccagcagattgatatgagaggaatgtatcagccagtggctggtggtatgcagccaccaccattacagcgtgcaccacccccaatgagaagcaaaaatccaggaccttcccaagggaaatcaatgtga

SEQ ID NO: 6811 - DNA, 382 bp, synthetic construct; identical to SEQ ID NO: 434
  misc_feature 1..382: note = Synthetic polypeptide
  source 1..382: mol_type = other DNA

SEQ ID NO: 6812 - DNA, 1828 bp, synthetic construct
  misc_feature 1..1828: note = Synthetic polypeptide
  source 1..1828: mol_type = other DNA
tgatatgtttggatttgtgtccccacctaaatctcatgatgaattgtaattcccaatgttgggggagggacctggtgggaggtgattggatcttggcggtggttttcccccttgctgttcttgtgacagtgagtgagttctcatgagatctgatggtttaaaagtgtgtggcacttccccattcactcactgtctctcctgccgtcacgtgaagatgtgcttgcttcccctttgcccttccaccgtaattgtgagtttcctgaggcctcaccagccatgcctcctgtacagcctgtggaactcaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctga

SEQ ID NO: 6813 - DNA, 404 bp, synthetic construct
  misc_feature 1..404: note = Synthetic polypeptide
  source 1..404: mol_type = other DNA
gctgggtggccttgagcaagccacttggcagctctgggccgcagttccgtcatctgcaagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccac

SEQ ID NO: 6814 - DNA, 417 bp, synthetic construct
  misc_feature 1..417: note = Synthetic polypeptide
  source 1..417: mol_type = other DNA
gctgggtggccttgagcaagccacttggcagctctgggccgcagttccgtcatctgcaagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaac

SEQ ID NO: 6815 - DNA, 485 bp, synthetic construct
  misc_feature 1..485: note = Synthetic polypeptide
  source 1..485: mol_type = other DNA
gctgggtggccttgagcaagccacttggcagctctgggccgcagttccgtcatctgcaagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccc

SEQ ID NO: 6816 - DNA, 1745 bp, synthetic construct
  misc_feature 1..1745: note = Synthetic polypeptide
  source 1..1745: mol_type = other DNA
gctgggtggccttgagcaagccacttggcagctctgggccgcagttccgtcatctgcaagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtag

SEQ ID NO: 6817 - DNA, 100 bp, synthetic construct
  misc_feature 1..100: note = Synthetic polypeptide
  source 1..100: mol_type = other DNA
ctgggtatgaatcaaggatcctttacttagtagttaactagaagactgggactagttaatttctccagtgctcagcttcttatctacaggtatctgctga

SEQ ID NO: 6818 - DNA, 769 bp, synthetic construct; identical to SEQ ID NO: 6486
  misc_feature 1..769: note = Synthetic polypeptide
  source 1..769: mol_type = other DNA

SEQ ID NO: 6819 - DNA, 1216 bp, synthetic construct
  misc_feature 1..1216: note = Synthetic polypeptide
  source 1..1216: mol_type = other DNA
cggcgtcggcggccgcggccggggacggtgtgagagcgtgaagcgtgacattcaggaaaacgatgaagaggcagtgcaagtcaaagagcagagcatcctggaactgggatctctcctggcaaagactggacaagctgcagagcttggaggactcctgaagtatgtacgacccttcttgaattccatcagcaaggctaaagcagctcgcctggtccgatctcttcttgatctgtttcttgatatggaagcagctacagggcaggaggtcgagctgtgtttagagtgcatcgaatgggccaagtcagagaaaagaactttcttacgccaagctttggaggcaagactggtgtctttgtactttgataccaagaggtaccaggaagcattgcatttgggttctcagctgctgcgggagttgaaaaagatggacgacaaagctcttttggtggaagtacagcttttagaaagcaaaacataccatgccctgagcaacctgccgaaagcccgagctgccttaacttctgctcgaaccacagcaaatgccatctactgcccccctaaattgcaggccaccttggacatgcagtcgggtattatccatgcagcagaagagaaggactggaaaactgcgtactcatacttctatgaggcatttgagggttatgactccatcgacagccccaaggccatcacatctctgaagtacatgttgctgtgcaaaatcatgctcaacaccccagaagatgtccaggctttggtgagcgggaagcttgcacttcggtatgcagggaggcagacagaagcattaaaatgcgtggctcaggctagcaagaacagatcactggcagattttgaaaaggctctgacagattaccgggcagagctccgggatgacccaatcatcagcacacacttggccaagttgtatgataacttactagaacagaatctgatccgagtcattgagcctttttccagagtacagattgaacacatatctagtctcatcaaactctccaaggccgacgtggaaaggaaattatcacagatgattcttgacaagaaatttcatgggattttggaccagggggagggtgtcctgattattttcgatgaacccccagtagataaaacttacgaagctgctctggaaacaattcagaacatgagcaaagtagtggattccctctacaacaaagccaagaaactgacatag

SEQ ID NO: 6820 - DNA, 510 bp, synthetic construct
  misc_feature 1..510: note = Synthetic polypeptide
  source 1..510: mol_type = other DNA
cggcgtcggcggccgcggccggggacggtgtgagagcgtgaagcgtgacattcaggaaaacgatgaagaggcagtgcaagtcaaagagcagagcatcctggaactgggatctctcctggcaaagactggacaagctgcagagcttggaggactcctgaagtatgtacgacccttcttgaattccatcagcaaggctaaagcagctcgcctggtccgatctcttcttgatctgtttcttgatatggaagcagctacagggcaggagtttctctttgttacagggcatttgatactttgggtctgttccatgctttgctttgtaagtggagattgtcagtggtccctggaatcctcattacatcagggtcacaaactgattcttgtctttgaggtcgagctgtgtttagagtgcatcgaatgggccaagtcagagaaaagaactttcttacgccaagctttggaggcaagactggtgtctttgtactttgataccaagaggtaccaggaagc

SEQ ID NO: 6821 - DNA, 2816 bp, synthetic construct
  misc_feature 1..2816: note = Synthetic polypeptide
  source 1..2816: mol_type = other DNA
ggttttttttttttttttttttttttttacaaattgagggtttgtggcagccctgaattgagcaagtttacgggcaccatttttccaaaagcatctccttcctttgtgtctctatataacattttggtaattcttgtggtatttcaaacttttcattactataacatctggtatggtcatctgtgatcagtgacctctgacgttactgttataattatttggggtaccgtgaagtgcacacatgtaagacagcaaacttaattggtaaatattatgtatattctggctgctctactaatcaatcatcctctagtctctttccgtctcctctggtctccctactccctaaggcacagcagtattgaaattaggtcaattaataaccctaccatggcttccaagtgttcaagtagaaggaagagttgcatgtgtatcactttacataaaaatgattaagcttagttcggaaggcatggttgaaagccaagataggccaaaagctaggcctcttgcaccaaacagttagctaaattttaaaatgcaaaggacacattcttgaaggaaattaaaagtgctgttccagtgaatacatcaaaggtaagcaagcaaaacaaccttattgctgatatggagaaagtttgagtagtctggatagaagatcaaatcagccacaacattctcttgagccaaagcctaatccagagcaatgccctctctctcttcattctaagaaggccaagagaagtgaggaagctgcagaagaaaagttggaagctagcagaggttggttcattaggcttaaggaaaacagctgtctccataacataaaagtacagtgtgcagcagcaagtgctatggagaagctgcagcaagttatccagaggatctagccaagatcattgatgaaggtggctacaccaaccagtagattttcaatgtaaatgaaacagccttctgctggaaaaagataacatctaggactttcatggctagagaggggaagaagttgatgcctggcttcaaagcttcaaaagacaggcttactttctcgtcagggaataatgcagctggtaactttaagttgaagccagtgctcatttatcattctgaaaatcctagggtactcaagaattatgctaaatccattctatctgtgctctataaatggaacaataaagcctggatgacagcacatctgtttacggcatggtttactgaagccctatgtggagacttactgctcagtaaaaaaatatttttttcaaaatattactgctgattgacagtgtacctagtcacccaagagctctgagggagatatgaaaggagatgaacattgtctatatgcccataccacaacatccattctgcaacccatgaatcaaggagcccttccaacttaagttttattatttaagacatatattttataaggctgtaggtgccatagagagtgattcctctgatggatctgggcaaagtaaattgaaaactttctgggaaggatttactattctagatgccattacaaacattcatgattgatgggaagaggtcaaaatattgacattaacaggagattagaagaagtttattctaatcctcatggatgactttgggttcaagatttcattggaggaaataactgctgatatggtgtgaatagcaagagaactagaattagaagtggagcctgaagatgtgactgaattgctgcaatcccatggtcaaacttgaagagataaggagttgtttcttatgggtgaacaaagaaagtggttcttgagatggaatctattcctggtgaagatgctgtgaaagttgttgaaatgacaacaaaggattgagaatattctgtaagcttcactgataaaggaactagcagggttggagatggtaaaatgctatcaagcagcatcacatgctacagagaaatattttgtgaaaggaagacttaatgcatcaaacttcattgttgtcttattttaggaaattgtcacagacaccccaacctttaccaaccaccaccccagtgagtcagcagccactaacatgaatgcaagaccctctaccaatagaaagattatgacttgttgaaagactcagatggttattaatacgttttagcggcacctgaatggacagaagaggacctcagccaactgacaagaagtatggttaagttcccaggagggactccaggtcgatgggaaaagattgcccacgaattgggtcgatctgtgacagatgtgacaaccaaagccaagcaactgaaggattcagtgacctgctccccaggaatggttagactctccgaactcaaatcgacagttcagaattccaggcccatcaaaacggccaccaccttgcccgatgacatgatcacccagcgagaggacgcagagggggtggcagcggaggaggagcaggagggagactccggtgagcaggagaccggggccactgatgcccggcctcggaggcggaagccagccaggctgctggaggctacagcgaagccggagccagaggagaagtccagagccaagcggcagaaggactttgacatagcagaacaaaacgagtccagcgacgaggagagcctgagaaaagagagagctcggtctgcagaggagccgtggactcaaaatcaacagaaacttctggaactggcgttgcagcagtacccaaggggatcctctgaccgctgggacaaaatagccagatgtgtcccgtccaagagcaaggaagactgtatcgctaggtacaagttgctggttgaactggtccaaaagaaaaaacaagctaaaagctga

SEQ ID NO: 6822 - DNA, 3057 bp, synthetic construct
  misc_feature 1..3057: note = Synthetic polypeptide
  source 1..3057: mol_type = other DNA
gcactgccactgctagccgtggccacgacagttccctgtgcctcagagcctcattttcttcatctgcgaggtgcagatagtgcacccctatgaagctgtgggaccttcttgtgtgagacgcctgtgttagcaatgcatgaagaaaacgtttacacggtggagtcaaaccgagttcaagttcgaacctggcaggggactgtcaaacaactcctccttttctcggagactgaggggaatccctgcttcttggacatctgtgggaatttcctggttgtagggacagacttggctcactttaaaagctttgatctttcccgaagagaggccaaagcacactgtagctgcaggagcctggcggagctggtccctggggtggggggcatcgcttctctgcggtgcagcagcagcgggagcaccatcagcatcctccccagcaaggctgacaacagccctgattccaaaatctgcttctacgatgttgaaatggacacagtgaccgtctttgacttcaagactggacaaattgatcggagagagacgctgtcctttaatgagcaagagactaataagagccacctctttgtggatgagggactgaaaaattatgttcccgtgaaccacttctgggaccagagtgagccccggctgtttgtatgcgaagccgtgcaggagacgccgcgctcccagcctcagtctgcaaacgggcagccccaagatgggcgcgctggccctgcggcagatgttttgatcctgtccttcttcatttccgaagagcacggcttcctgcttcatgagagcttcccccggcctgccacctcccacagtctcctggggatggaagtgccttattactacttcacaagaaagcccgaagaagcagacagagaagacgaggtggagcctgggtgccaccacatccctcagatggtgtccaggagacccctgcgagactttgtggggctggaggactgcgacaaggccacccgggacgccatgctccacttcagcttctttgtcaccataggagacatggacgaagccttcaaatccatcaagctcatcaaaagtgaggccgtctgggagaacatggcgcgcatgtgcgtgaagacccagcggctggacgtggccaaggtgtgcctggggaacatgggccatgcccgcggggcccgagcgctgcgtgaggcggagcaggagccggagctagaggcccgcgtggccgtgctggccacgcagctgggcatgctggaggacgccgagcagctgtacaggaagtgcaagcgccacgacctcctgaacaagttctaccaggctgcgggccggtggcaggaggccctccaggtagccgagcaccacgatcgcgtgcacctgcgcagcacctaccaccgctatgccgggcacctggaggccagcgccgactgcagccgggccctcagttactacgagaagtcggacacgcaccgcttcgaggtgcccaggatgctgtcggaggacctgccgtccctggagctctacgtgaataaaatgaaggataagaccctgtggcggtggtgggcgcagtacctggagagccagggcgagatggacgccgcgctgcactactacgagctggcccgggaccacttctccctggtccgcatccactgcttccagggcaatgtccagaaggctgcgcaaatagccaacgagacaggaaacctggcggcctcctaccacctcgcccgccagtacgagagccaggaggaggtcgggcaggcggtgcacttctacacccgggcacaggccttcaagaatgccatccgcctgtgcaaggagaacggcctggacgaccagctcatgaacttggccctgctgagctcccccgaggacatgatcgaggcggcccgatactacgaggagaagggcgtgcagatggacagggcggtcatgctgtaccacaaggctggccacttctccaaggccctggagctggcctttgccacccagcagtttgtggccctacagctcatagcagaggacctggatgagacgtcagaccctgcgctcctggcccgctgctccgacttcttcatcgagcacagtcagtacgagagggcggtagagctgctgctggctgccaggaagtatcaggaagccctgcagctgtgcctggggcagaacatgagcatcaccgaggagatggcggaaaagatgaccgtggccaaggactcctcggacctgcctgaggagtcgcggcgggagctgctggagcagatagcagactgctgcatgcgccagggcagctaccacctggccaccaagaagtacacgcaggccggcaacaagctgaaggccatgagggcgctgctcaaatccggagacacggagaaaatcacgttcttcgcgagcgtgtccaggcagaaggaaatctacatcatggctgctaactacctgcagtccctggactggcggaaggagccggagatcatgaagaacatcatcggcttctacaccaaggggcgggccctggacctcctggctggcttttatgacgcttgtgcccaggtggagattgatgaataccagaactacgacaaagcccacggggcgctgaccgaggcctacaagtgcctggccaaggccaaggccaagagccccctggaccaggagaccaggctggcgcagctgcagagcaggatggcactggtgaagaggttcatccaggcccgcaggacgtacacagaggaccccaaggagtccatcaagcagtgtgagctgctcctggaggaaccagacctggacagcaccatccgcatcggggacgtctatggcttcctggtggagcactacgtgcggaaggaggaataccagacggcctacagattcctggaggagatgcggcggcggcttcccttggccaacatgtcctactacgtgagcccgcaggccgtggacgccgtgcaccgggggctgggtctcccactgccacgcaccgtccccgagcaggtccgccacaacagcatggaggacgccagggagctggacgaggaggtggtggaagaggcagatgacgacccctga

SEQ ID NO: 6823 - DNA, 116 bp, synthetic construct
  misc_feature 1..116: note = Synthetic polypeptide
  source 1..116: mol_type = other DNA
gcactgccactgctagccgtggccacgacagttccctgtgcctcagagcctcattttcttcatctgcgaggtgcagatagtgcacccctatgaagctgtgggaccttcttgtgtga

SEQ ID NO: 6824 - DNA, 1999 bp, synthetic construct
  misc_feature 1..1999: note = Synthetic polypeptide
  source 1..1999: mol_type = other DNA
ggccatgaatattgtcacttcagtgctgctgctttatgccaaagaggaggaagctttctggctgcttgtggctttgtgtgagcgcatgctcccagattactacaacaccagagttgtgggtgcactggtggaccaaggtgtctttgaggagctagcacgagactacgtcccacagctgtacgactgcatgcaagacctgggcgtgatttccaccatctccctgtcttggttcctcacactatttctcagtgtgatgccttttgagagtgcagttgtggttgttgactgtttcttctatgaaggaattaaagtgatattccagttggccctagctgtgctggatgcaaatgtggacaaactgttgaactgcaaggatgatggggaggccatgaccgttttgggaaggtatttagacagtgtgaccaataaagacagcacactgcctcccattcctcacctccactccttgctcagcgatgatgtggaaccttaccctgaggtagacatctttagactcatcagaacttcctacgagaaattcggaactatccgggcagatttgattgaacagatgagattcaaacagagactgaaagtgatccagacgctggaggatactacgaaacgcaacgtggtacgaaccattgtgacagaaacttcctttaccattgatgagctggaagaactttatgctcttttcaaggcagaacatctcaccagctgctactggggcgggagcagcaacgcgctggaccggcatgaccccagcctgccctacctggaacagtatcgcattgacttcgagcagttcaagggaatgtttgctcttctctttccttgggcatgtggaactcactctgacgttctggcctcccgcttgttccagttattagatgaaaatggagactctttgattaacttccgggagtttgtctctgggctaagtgctgcatgccatggggacctcacagagaagctcaaactcctgtacaaaatgcacgtcttgcctgagccatcctctgatcaagatgaaccagattctgcttttgaagcaactcagtacttctttgaagatattaccccagaatgtacacatgttgttggattggatagcagaagcaaacagggtgcagatgatggctttgttacggtgagcctaaagccagacaaagggaagagagcaaattcccaagaaaatcgtaattatttgagactgtggactccagaaaataaatctaagtcaaagaatgcaaaggatttacccaaattaaatcaggggcagttcattgaactgtgtaagacaatgtataacatgttcagcgaagaccccaatgagcaggagctgtaccacgccacggcagcagtgaccagcctcctgctggagattggggaggtcggcaagttgttcgtggcccagcctgcaaaggagggcgggagcggaggcagtgggccgtcctgccaccagggcatcccaggcgtgctcttccccaagaaagggccaggccagccttacgtggtggagtctgttgagcccctgccggccagcctggcccccgacagcgaggaacactcccttggaggacaaatggaggacatcaagctggaggactcctcgccccgggacaacggggcctgctcctccatgctgatctctgacgacgacaccaaggacgacagctccatgtcctcatactcggtgctgagtgccggctcccacgaggaggacaagctgcactgcgaggacatcggagaggacacggtcctggtgcggagcggccagggcacggcggcactgccccggagcaccagcctggaccgggactgggccatcaccttcgagcagttcctggcctccctcttaactgagcctgccctggtcaagtactttgacaagcccgtgtgcatgatggccaggattaccagtgcaaaaaacatccggatgatgggcaagcccctcacctcggccagtgactatgaaatctcggccatgtccggctga

SEQ ID NO: 6825 - DNA, 425 bp, synthetic construct
  misc_feature 1..425: note = Synthetic polypeptide
  source 1..425: mol_type = other DNA
aggtctttcaagctggaaacgtgtgggctcaaatgagactccattgcttgctatggactgttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggtataaagcccttggaaaagcacaagacataa

SEQ ID NO: 6826 - DNA, 1013 bp, synthetic construct
  misc_feature 1..1013: note = Synthetic polypeptide
  source 1..1013: mol_type = other DNA
aggtctttcaagctggaaacgtgtgggctcaaatgagactccattgcttgctatggactgttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcatatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaa

SEQ ID NO: 6827 - DNA, 413 bp, synthetic construct
  misc_feature 1..413: note = Synthetic polypeptide
  source 1..413: mol_type = other DNA
aggtctttcaagctggaaacgtgtgggctcaaatgagactccattgcttgctatggactgttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggtataaaggtgaagaattga

SEQ ID NO: 6828 - DNA, 854 bp, synthetic construct
  misc_feature 1..854: note = Synthetic polypeptide
  source 1..854: mol_type = other DNA
aggtctttcaagctggaaacgtgtgggctcaaatgagactccattgcttgctatggactgttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagagaaattcttcatgaaatattttctacggctagatcttaattcctataatagtacttggcaacatggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcatatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaa

SEQ ID NO: 6829 - DNA, 742 bp, synthetic construct; identical to SEQ ID NO: 6357
  misc_feature 1..742: note = Synthetic polypeptide
  source 1..742: mol_type = other DNA

SEQ ID NO: 6830 - DNA, 590 bp, synthetic construct; identical to SEQ ID NO: 6358
  misc_feature 1..590: note = Synthetic polypeptide
  source 1..590: mol_type = other DNA

SEQ ID NO: 6831 - DNA, 577 bp, synthetic construct; identical to SEQ ID NO: 6359
  misc_feature 1..577: note = Synthetic polypeptide
  source 1..577: mol_type = other DNA

SEQ ID NO: 6832 - DNA, 430 bp, synthetic construct; identical to SEQ ID NO: 6360
  misc_feature 1..430: note = Synthetic polypeptide
  source 1..430: mol_type = other DNA

SEQ ID NO: 6833 - DNA, 670 bp, synthetic construct; identical to SEQ ID NO: 6361
  misc_feature 1..670: note = Synthetic polypeptide
  source 1..670: mol_type = other DNA

SEQ ID NO: 6834 - DNA, 2262 bp, synthetic construct
  misc_feature 1..2262: note = Synthetic polypeptide
  source 1..2262: mol_type = other DNA
ggccaggtgtggtggctcacgcctgtaatcccagcactttggtaggccaaggtgggtggatcacgaggtcaggagatccagaccatcctggctaacatggtgaaacctcacctctactagaaatacaaaaaatcagccgggcgtggtggtgggtgcctgtagtcccagctactccggaggctgaggcaagagaatggcgtgaacccgcgaggcggagcttgtgggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacgcatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagattcaactagcctatcaaaaatcttggatacagttcattcttgtgaaagagcaagggaacttcaaaaagatcactgtgaacaacgtacaggaaaaatggaacaaatgaaaaagaagttttgtgtactgaaaaagaaactgtcagaagcaaaagaaataaaatcacagttagagaaccaaaaagttaaatgggaacaagagctctgcagtgtgagattgactttaaaccaagaagaagagaagagaagaaatgccgatatattaaatgaaaaaattagggaagaattaggaagaatcgaagagcagcataggaaagagttagaagtgaaacaacaacttgaacaggctctcagaatacaagatatagaattgaagagtgtagaaagtaatttgaatcaggtttctcacactcatgaaaatgaaaattatctcttacatgaaaattgcatgttgaaaaaggaaattgccatgctaaaactggaaatagccacactgaaacaccaataccaggaaaaggaaaataaatactttgaggacattaagattttaaaagaaaagaatgctgaacttcagatgaccctaaaactgaaagaggaatcattaactaaaagggcatctcaatatagtgggcagcttaaagttctgatagctgagaacacaatgctcacttctaaattgaaggaaaaacaagacaaagaaatactagaggcagaaattgaatcacaccatcctagactggcttctgctgtacaagaccatgatcaaattgtgacatcaagaaaaagtcaagaacctgctttccacattgcaggagatgcttgtttgcaaagaaaaatgaatgttgatgtgagtagtacgatatataacaatgaggtgctccatcaaccactttctgaagctcaaaggaaatccaaaagcctaaaaattaatctcaattatgcaggagatgctctaagagaaaatacattggtttcagaacatgcacaaagagaccaacgtgaaacacagtgtcaaatgaaggaagctgaacacatgtatcaaaacgaacaagataatgtgaacaaacacactgaacagcaggagtctctagatcagaaattatttcaactacaaagcaaaaatatgtggcttcaacagcaattagttcatgcacataagaaagctgacaacaaaagcaagataacaattgatattcattttcttgagaggaaaatgcaacatcatctcctaaaagagaaaaatgaggagatatttaattacaataaccatttaaaaaaccgtatatatcaatatgaaaaagagaaagcagaaacagaaaactcatga

SEQ ID NO: 6835 - DNA, 2619 bp, synthetic construct
  misc_feature 1..2619: note = Synthetic polypeptide
  source 1..2619: mol_type = other DNA
ggccaggtgtggtggctcacgcctgtaatcccagcactttggtaggccaaggtgggtggatcacgaggtcaggagatccagaccatcctggctaacatggtgaaacctcacctctactagaaatacaaaaaatcagccgggcgtggtggtgggtgcctgtagtcccagctactccggaggctgaggcaagagaatggcgtgaacccgcgaggcggagcttgtgggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacgcatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagattcaactagcctatcaaaaatcttggatacagttcattcttgtgaaagagcaagggaacttcaaaaagatcactgtgaacaacgtacaggaaaaatggaacaaatgaaaaagaagttttgtgtactgaaaaagaaactgtcagaagcaaaagaaataaaatcacagttagagaaccaaaaagttaaatgggaacaagagctctgcagtgtgagattgactttaaaccaagaagaagagaagagaagaaatgccgatatattaaatgaaaaaattagggaagaattaggaagaatcgaagagcagcataggaaagagttagaagtgaaacaacaacttgaacaggctctcagaatacaagatatagaattgaagagtgtagaaagtaatttgaatcaggtttctcacactcatgaaaatgaaaattatctcttacatgaaaattgcatgttgaaaaaggaaattgccatgctaaaactggaaatagccacactgaaacaccaataccaggaaaaggaaaataaatactttgaggacattaagattttaaaagaaaagaatgctgaacttcagatgaccctaaaactgaaagaggaatcattaactaaaagggcatctcaatatagtgggcagcttaaagttctgatagctgagaacacaatgctcacttctaaattgaaggaaaaacaagacaaagaaatactagaggcagaaattgaatcacaccatcctagactggcttctgctgtacaagaccatgatcaaattgtgacatcaagaaaaagtcaagaacctgctttccacattgcaggagatgcttgtttgcaaagaaaaatgaatgttgatgtgagtagtacgatatataacaatgaggtgctccatcaaccactttctgaagctcaaaggaaatccaaaagcctaaaaattaatctcaattatgcaggagatgctctaagagaaaatacattggtttcagaacatgcacaaagagaccaacgtgaaacacagtgtcaaatgaaggaagctgaacacatgtatcaaaacgaacaagataatgtgaacaaacacactgaacagcaggagtctctagatcagaaattatttcaactacaaagcaaaaatatgtggcttcaacagcaattagttcatgcacataagaaagctgacaacaaaagcaagataacaattgatattcattttcttgagaggaaaatgcaacatcatctcctaaaagagaaaaatgaggagatatttaattacaataaccatttaaaaaaccgtatatatcaatatgaaaaagagaaagcagaaacagaaaactcatga

SEQ ID NO: 6836 - DNA, 305 bp, synthetic construct
  misc_feature 1..305: note = Synthetic polypeptide
  source 1..305: mol_type = other DNA
actagttacaagatgaactggcattacatgcctcctgatacgatgcaatgagaagaacacaacagcatgtctttgatattcctgtggaaaatacataccctcaatcttaccatgagcaaacatcagacaaactcaaatcaagggacattctacaaaataattgacctacattcttcaacagtgtcagcggaggctcacgaggcatggtgactgaagccccgcaggaggtgggatttgcaaaggacattattggaatgaagggtgaaatttgaataagggaccagctctgtgaacacggcaagtaa

SEQ ID NO: 6837 - DNA, 2262 bp, synthetic construct; identical to SEQ ID NO: 6834
  misc_feature 1..2262: note = Synthetic polypeptide
  source 1..2262: mol_type = other DNA

SEQ ID NO: 6838 - DNA, 2262 bp, synthetic construct; identical to SEQ ID NO: 6834
  misc_feature 1..2262: note = Synthetic polypeptide
  source 1..2262: mol_type = other DNA

SEQ ID NO: 6839 - DNA, 250 bp, synthetic construct
  misc_feature 1..250: note = Synthetic polypeptide
  source 1..250: mol_type = other DNA
taagtaaggacaacaagaactttaaacaaattttgaactctagctggtaggtttataatttgaagaggccggggtgagcaattctagtctgtacgtattctaggattgatcaaataaatatatcacggataatgggagctggattcctcactgcctgagaaaagaacacaaatagagaaagggagaaagaataaaccctgtaatgctgaaacggaattaaagggaccagctctgtgaacacggcaagtaa

SEQ ID NO: 6840 - DNA, 294 bp, synthetic construct; identical to SEQ ID NO: 6413
  misc_feature 1..294: note = Synthetic polypeptide
  source 1..294: mol_type = other DNA

SEQ ID NO: 6841 - DNA, 462 bp, synthetic construct; identical to SEQ ID NO: 6414
  misc_feature 1..462: note = Synthetic polypeptide
  source 1..462: mol_type = other DNA

SEQ ID NO: 6842 - DNA, 522 bp, synthetic construct; identical to SEQ ID NO: 6415
  misc_feature 1..522: note = Synthetic polypeptide
  source 1..522: mol_type = other DNA

SEQ ID NO: 6843 - DNA, 414 bp, synthetic construct; identical to SEQ ID NO: 6416
  misc_feature 1..414: note = Synthetic polypeptide
  source 1..414: mol_type = other DNA

SEQ ID NO: 6844 - DNA, 405 bp, synthetic construct; identical to SEQ ID NO: 6417
  misc_feature 1..405: note = Synthetic polypeptide
  source 1..405: mol_type = other DNA

SEQ ID NO: 6845 - DNA, 583 bp, synthetic construct
  misc_feature 1..583: note = Synthetic polypeptide
  source 1..583: mol_type = other DNA
tgtggtaggcagaatagcggcccccttaaagatgttcatgtcctaatccccaaaccctgtgaatatgttgccttacatggcaaaagggagattgcagatgtgattactgattttgagatggggagatttcctggattatgcaggttggaccaatggaatcacaagtgtcctaataaatgaaggaggaaggcaggagagtcagagtcagaatgatgcaatgtgtaaacggctcaactggccattcctctctttgaagatggggtcaggccacaagccaaggaacggaggcagcctcttgaacctgaaaaaggcaagaaaatggattctcccctagtgccttcagaaggaacgtggacaagcagaactgttcaaaagaagaggctgttctaagaaagactaccgagtaatcaatcacctcctcagagaaagtctgctcaggaaactctcctcccaccagcccctgcacttggttccttgcgttgcctctggctggaagctgttgtccccaacttcagaaagtgtctgcagatttcacaggctctctcttgggtcaagggaccagctctgtgaacacggcaagtaa

SEQ ID NO: 6846 - DNA, 466 bp, synthetic construct
  misc_feature 1..466: note = Synthetic polypeptide
  source 1..466: mol_type = other DNA
tgtggtaggcagaatagcggcccccttaaagatgttcatgtcctaatccccaaaccctgtgaatatgttgccttacatggcaaaagggagattgcagatgtgattactgattttgagatggggagatttcctggattatgcaggttggaccaatggaatcacaagtgtcctaataaatgaaggaggaaggcaggagagtcagagtcagaatgatgcaatgtgtaaacggctcaactggccattcctctctttgaagatggggtcaggccacaagccaaggaacggaggcagcctcttgaacctgaaaaaggcaagaaaatggattctcccctagtgccttcagaaggaacgtggacaagcagaactgttcaaaagaagaggctgttctaagaaagactaccgagtaatcaatcacctcctcagagaaagtctgctcagggaccagctctgtgaacacggcaagtaa

SEQ ID NO: 6847 - DNA, 413 bp, synthetic construct
  misc_feature 1..413: note = Synthetic polypeptide
  source 1..413: mol_type = other DNA
aaaagtatacgttttcaataggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagacccttctttaacagttagagctgacatagctggaagatactctaacagattgtacacatatgagcctcgggatttacccctattgatagaaaacatgaagaaagcattaagacttattcagtcagagctataa

SEQ ID NO: 6848 - DNA, 404 bp, synthetic construct
  misc_feature 1..404: note = Synthetic polypeptide
  source 1..404: mol_type = other DNA
aaaagtatacgttttcaataggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagacccttctttaacagttagagctgacatagctggaagatactctaacagattgtacacatatgagcctcgggatttacccctatgtaagtattcacaaatgatctcaaacagtggtcatagctga

SEQ ID NO: 6849 - DNA, 363 bp, synthetic construct
  misc_feature 1..363: note = Synthetic polypeptide
  source 1..363: mol_type = other DNA
aaaagtatacgttttcaataggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagacccttctttaacagttagagctgacatagctggaagatactctaacagattgtacacatatgagcctcgggatttacccctat

SEQ ID NO: 6850 - DNA, 326 bp, synthetic construct
  misc_feature 1..326: note = Synthetic polypeptide
  source 1..326: mol_type = other DNA
ctgctcaggaggctgaggcaggaagatcacttgagcccaggagtttgaggctgcggcaccgtataaacttgagttcagacttcctgattactcctgatttctactgggacagagaaaacctggaaggactttacgataaaacgtgtcaattccttagcattggccgaagagttaaggtcatgaatgaaaaacttcagcactgcatggaactaacagatctaatgcggaatcacctgaatgagaagagggcactccgcttggagtggatgattgtcatcctcattaccatagaggtaatgtttgagctgggacgagtatttttctga

SEQ ID NO: 6851 - DNA, 119 bp, synthetic construct
  misc_feature 1..119: note = Synthetic polypeptide
  source 1..119: mol_type = other DNA
ctgctcaggaggctgaggcaggaagatcacttgagcccaggagtttgaggctgcggcaccgtataaacttgagttcagacttcctgattactcctgatttctactgggacagagaaaac

SEQ ID NO: 6852 - DNA, 1861 bp, synthetic construct; identical to SEQ ID NO: 6680
  misc_feature 1..1861: note = Synthetic polypeptide
  source 1..1861: mol_type = other DNA

SEQ ID NO: 6853 - DNA, 1123 bp, synthetic construct; identical to SEQ ID NO: 6681
  misc_feature 1..1123: note = Synthetic polypeptide
  source 1..1123: mol_type = other DNA

SEQ ID NO: 6854 - DNA, 1850 bp, synthetic construct
  misc_feature 1..1850: note = Synthetic polypeptide
  source 1..1850: mol_type = other DNA
gagaacaggaactatgttatttatctttgctctctctgctgtgcctgtcctggggcatgtgttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaagttcaacaaatcctacaatggcactgtggactga

SEQ ID NO: 6855 - DNA, 889 bp, synthetic construct
  misc_feature 1..889: note = Synthetic polypeptide
  source 1..889: mol_type = other DNA
gagaacaggaactatgttatttatctttgctctctctgctgtgcctgtcctggggcatgtgttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaagagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccgggg

SEQ ID NO: 6856 - DNA, 850 bp, synthetic construct
  misc_feature 1..850: note = Synthetic polypeptide
  source 1..850: mol_type = other DNA
gagaacaggaactatgttatttatctttgctctctctgctgtgcctgtcctggggcatgtgttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccag

SEQ ID NO: 6857 - DNA, 192 bp, synthetic construct
  misc_feature 1..192: note = Synthetic polypeptide
  source 1..192: mol_type = other DNA
gagaacaggaactatgttatttatctttgctctctctgctgtgcctgtcctggggcatgtgttacaagttgtttccaaattgcgtcccctcctttgggttccgccatctgctgcctctcacagacagagtggacagcttcaatgaggaagttcggaaacagagggtgtcccggaaccgagatgcccctgagg

SEQ ID NO: 6858 - DNA, 593 bp, synthetic construct
  misc_feature 1..593: note = Synthetic polypeptide
  source 1..593: mol_type = other DNA
aatccaaccacttcctattgcctccatgctactgccctggtccaagcccagatcagatcttgtctagactaccataacagtcacctaactggccaccctacagccagtccacacagaagccagagtgaggctggtagacataaatcagattccatcactcacgtgctcaagtggcttcttatcacagaactaaatccaaatttctgatcacaacctatgaggctgacatgatcaggccaatggctatctctcccttcctaccactctcctcttgctttcttcactctctccagcctggccttcgtgctgttcctcccacagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaa

SEQ ID NO: 6859 - DNA, 635 bp, synthetic construct
  misc_feature 1..635: note = Synthetic polypeptide
  source 1..635: mol_type = other DNA
aatccaaccacttcctattgcctccatgctactgccctggtccaagcccagatcagatcttgtctagactaccataacagtcacctaactggccaccctacagccagtccacacagaagccagagtgaggctggtagacataaatcagattccatcactcacgtgctcaagtggcttcttatcacagaactaaatccaaatttctgatcacaacctatgaggctgacatgatcaggccaatggctatctctcccttcctaccactctcctcttgctttcttcactctctccagcctggccttcgtgctgttcctcccacagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgtgtaagtgtgaccttcaattcggatgttgcccaagagttgaacacctctattgctgtagtgatgggactagaggctgcatggtgagtgcttga

SEQ ID NO: 6860 - DNA, 632 bp, synthetic construct
  misc_feature 1..632: note = Synthetic polypeptide
  source 1..632: mol_type = other DNA
aatccaaccacttcctattgcctccatgctactgccctggtccaagcccagatcagatcttgtctagactaccataacagtcacctaactggccaccctacagccagtccacacagaagccagagtgaggctggtagacataaatcagattccatcactcacgtgctcaagtggcttcttatcacagaactaaatccaaatttctgatcacaacctatgaggctgacatgatcaggccaatggctatctctcccttcctaccactctcctcttgctttcttcactctctccagcctggccttcgtgctgttcctcccacagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgtgtaagtgtgaccttcaattcggatgttgcccaagagttgaacacctctattgctgtagtgatgggactagaggctgcatggtgaggtga

SEQ ID NO: 6861 - DNA, 459 bp, synthetic construct
  misc_feature 1..459: note = Synthetic polypeptide
  source 1..459: mol_type = other DNA
aatccaaccacttcctattgcctccatgctactgccctggtccaagcccagatcagatcttgtctagactaccataacagtcacctaactggccaccctacagccagtccacacagaagccagagtgaggctggtagacataaatcagattccatcactcacgtgctcaagtggcttcttatcacagaactaaatccaaatttctgatcacaacctatgaggctgacatgatcaggccaatggctatctctcccttcctaccactctcctcttgctttcttcactctctccagcctggccttcgtgctgttcctcccacagctttaaagaaagtgtttgctgaaaataaagaaatccagaaattggcagagcagtttgtcctcctcaatctggtttatgaaacaactgacaaacacctttctcctgatggccagtatgtccccaggattatgtttgttg

SEQ ID NO: 6862 - DNA, 68 bp, synthetic construct
  misc_feature 1..68: note = Synthetic polypeptide
  source 1..68: mol_type = other DNA
ggccaggcacggtggctcacgcctgtaatcccagcacttcgggaggccaaggcctgggcaatatttaa

SEQ ID NO: 6863 - DNA, 1053 bp, synthetic construct
  misc_feature 1..1053: note = Synthetic polypeptide
  source 1..1053: mol_type = other DNA
ggccaggcacggtggctcacgcctgtaatcccagcacttcgggaggccaaggcctgggcaatatttaagggaaagtataaggagggggacacaggaggtccagctgtctggaagactcgcctgcgctgtgcactcaacaagagttctgaatttaaggaggttcctgagaggggccgcatggatgttgctgagccctacaaggtgtatcagttgctgccaccaggaatcgtctctggccagccagggactcagaaagtaccatcaaagcgacagcacagttctgtgtcctctgagaggaaggaggaagaggatgccatgcagaactgcacactcagtccctctgtgctccaggactccctcaataatgaggaggagggggccagtgggggagcagtccattcagacattgggagcagcagcagcagcagcagccctgagccacaggaagttacagacacaactgaggccccctttcaaggggatcagaggtccctggagtttctgcttcctccagagccagactactcactgctgctcaccttcatctacaacgggcgcgtggtgggcgaggcccaggtgcaaagcctggattgccgccttgtggctgagccctcaggctctgagagcagcatggagcaggtgctgttccccaagcctggcccactggagcccacgcagcgcctgctgagccagcttgagaggggcatcctagtggccagcaacccccgaggcctcttcgtgcagcgcctttgccccatccccatctcctggaatgcaccccaggctccacctgggccaggcccgcatctgctgcccagcaacgagtgcgtggagctcttcagaaccgcctacttctgcagagacttggtcaggtactttcagggcctgggccccccaccgaagttccaggtaacactgaatttctgggaagagagccatggctccagccatactccacagaatcttatcacagtgaagatggagcaggcctttgcccgatacttgctggagcagactccagagcagcaggcagccattctgtccctggtgtag

SEQ ID NO: 6864 - DNA, 407 bp, synthetic construct
  misc_feature 1..407: note = Synthetic polypeptide
  source 1..407: mol_type = other DNA
ggccaggcacggtggctcacgcctgtaatcccagcacttcgggaggccaaggcctgggcaatatttaagggaaagtataaggagggggacacaggaggtccagctgtctggaagactcgcctgcgctgtgcactcaacaagagttctgaatttaaggaggttcctgagaggggccgcatggatgttgctgagccctacaaggtgtatcagttgctgccaccaggaatcgtctctggccagccagggactcagaaagtaccatcaaagcgacagcacagttctgtgtcctctgagaggaaggaggaagaggatgccatgcagaactgcacactcagtccctctgtgctccaggactccctcaataatttacagacacaactgaggccccctttcaaggggatcagagg

SEQ ID NO: 6865 - DNA, 673 bp, synthetic construct
  misc_feature 1..673: note = Synthetic polypeptide
  source 1..673: mol_type = other DNA
ggccaggcacggtggctcacgcctgtaatcccagcacttcgggaggccaaggcctgggcaatatttaagggaaagtataaggagggggacacaggaggtccagctgtctggaagactcgcctgcgctgtgcactcaacaagagttctgaatttaaggaggttcctgagaggggccgcatggatgttgctgagccctacaaggtgtatcagttgctgccaccaggaatcgtctctggccagccagggactcagaaagtaccatcaaagcgacagcacagttctgtgtcctctgagaggaaggaggaagaggatgccatgcagaactgcacactcagtccctctgtgctccaggactccctcaataatgaggaggagggggccagtgggggagcagtccattcagacattgggagcagcagcagcagcagcagccctgagccacaggaagttacagacacaactgaggccccctttcaaggggatcagaggtccctggagtttctgcttcctccagagccagcaccaggtagggctgttctatccccagactactcactgctgctcaccttcatctacaacgggcgcgtggtgggcgaggcccaggtgcaaagcctggattgccgccttgtggctgagccctcaggctctgagagcagcatggagcaggtgctgt

SEQ ID NO: 6866 - DNA, 871 bp, synthetic construct; identical to SEQ ID NO: 437
  misc_feature 1..871: note = Synthetic polypeptide
  source 1..871: mol_type = other DNA

SEQ ID NO: 6867 - DNA, 421 bp, synthetic construct; identical to SEQ ID NO: 441
  misc_feature 1..421: note = Synthetic polypeptide
  source 1..421: mol_type = other DNA

SEQ ID NO: 6868 - DNA, 638 bp, synthetic construct; identical to SEQ ID NO: 442
  misc_feature 1..638: note = Synthetic polypeptide
  source 1..638: mol_type = other DNA

SEQ ID NO: 6869 - DNA, 337 bp, synthetic construct; identical to SEQ ID NO: 443
  misc_feature 1..337: note = Synthetic polypeptide
  source 1..337: mol_type = other DNA

SEQ ID NO: 6870 - DNA, 254 bp, synthetic construct
  misc_feature 1..254: note = Synthetic polypeptide
  source 1..254: mol_type = other DNA
gctaggtgtggtggcgcacgcctgtagttccagctacttgggaggctgaagtgggaggatcacttgagcccaggagttcaagatcagcctggacaacatagtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaat

SEQ ID NO: 6871 - DNA, 415 bp, synthetic construct
  misc_feature 1..415: note = Synthetic polypeptide
  source 1..415: mol_type = other DNA
gctaggtgtggtggcgcacgcctgtagttccagctacttgggaggctgaagtgggaggatcacttgagcccaggagttcaagatcagcctggacaacatagtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtggtcttcaagctgacagagaagctgacggaacagaaggagtggatgaagatataattgtgacccaaagtcagaccaacttcacctgccccattacaaaggaggaaatgaagaagccagtgaaaaataaagtgtgtggccacacctatgaagaggacgcc

SEQ ID NO: 6872 - DNA, 580 bp, synthetic construct
  misc_feature 1..580: note = Synthetic polypeptide
  source 1..580: mol_type = other DNA
gctaggtgtggtggcgcacgcctgtagttccagctacttgggaggctgaagtgggaggatcacttgagcccaggagttcaagatcagcctggacaacatagtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtggtcttcaagctgacagagaagctgacggaacagaaggagtggatgaagatataattgtgacccaaagtcagaccaacttcacctgccccattacaaaggaggaaatgaagaagccagtgaaaaataaagtgtgtggccacacctatgaagaggacgccattgttcgcatgattgagtccaggcaaaagcggaagaaaaaggcctattgccctcaaattggctgtagccacacggatataagaaagtcagatcttatccaggatgaagcacttagaagggcaattgagaaccataacaagaaaagacatcgtcattccgagtag

SEQ ID NO: 6873 - DNA, 171 bp, synthetic construct
  misc_feature 1..171: note = Synthetic polypeptide
  source 1..171: mol_type = other DNA
ggccaggtgcggtggctctcatctgtaatcccagcactctgggaggccgaggcctccccaaagccagtcctgtgtcaccaatcaaaggaaaggaagccgtcagcagagatgaacagaataaccaccaaggaagccacttcctcctgccccccaaaatcccctcttggagag

SEQ ID NO: 6874 - DNA, 633 bp, synthetic construct
  misc_feature 1..633: note = Synthetic polypeptide
  source 1..633: mol_type = other DNA
ggccaggtgcggtggctctcatctgtaatcccagcactctgggaggccgaggcctccccaaagccagtcctgtgtcaccaatcaaaggaaaggaagccgtcagcagagatgaacagaataaccaccaaggaagccacttcctcctgccccccaaaatcccctcttggagagacccgccagaaactctggaggagcctcaaaatgctccccgagagaggccagagggtccggcagcagaaaagccacctcgccactgtgaacttgtcgtcactcttggatgtccggagatccacggtgatctcaggccctgggaccggaaaaggcagccaagatcactcaggggatcccacctcgggggacagaggctacacggatccctgtgtggccacatctctcaaaagcccctcacagccccaggcaccaaaagacagaaaggtccccaccaggaaggccgagaggtcggtcagctgcattgaggtgaccccaggggacaggagttggcaccaaatggtagtgagagccctatcctcccaggagtccaagccagagcaccagggcttggcagagcctgagaacgaccagctcccggaggagtaccaacaaccgccaccctttgcccctgggtactgctag

SEQ ID NO: 6875 - DNA, 636 bp, synthetic construct
  misc_feature 1..636: note = Synthetic polypeptide
  source 1..636: mol_type = other DNA
ggccaggtgcggtggctctcatctgtaatcccagcactctgggaggccgaggcctccccaaagccagtcctgtgtcaccaatcaaaggaaaggaagccgtcagcagagatgaacagaataaccaccaaggaagccacttcctcctgccccccaaaatcccctcttggagagacccgccagaaactctggaggagcctcaaaatgctccccgagagaggccagagggtccggcagcagctaaaaagccacctcgccactgtgaacttgtcgtcactcttggatgtccggagatccacggtgatctcaggccctgggaccggaaaaggcagccaagatcactcaggggatcccacctcgggggacagaggctacacggatccctgtgtggccacatctctcaaaagcccctcacagccccaggcaccaaaagacagaaaggtccccaccaggaaggccgagaggtcggtcagctgcattgaggtgaccccaggggacaggagttggcaccaaatggtagtgagagccctatcctcccaggagtccaagccagagcaccagggcttggcagagcctgagaacgaccagctcccggaggagtaccaacaaccgccaccctttgcccctgggtactgctag

SEQ ID NO: 6876 - DNA, 480 bp, synthetic construct
  misc_feature 1..480: note = Synthetic polypeptide
  source 1..480: mol_type = other DNA
ggccaggtgcggtggctctcatctgtaatcccagcactctgggaggccgaggcctccccaaagccagtcctgtgtcaccaatcaaaggaaaggaagccgtcagcagagatgaacagaataaccaccaaggaagccacttcctcctgccccccaaaatcccctcttggagagacccgccagaaactctggaggagcctcaaaatgctccccgagagaggccagagggtccggcagcagctaaaaaagccacctcgccactgtgaacttgtcgtcactcttggatgtccggagatccacggtgatctcaggccctgggaccggaaaaggcagccaagatcactcaggggatcccacctcgggggacagaggctacacggatccctgtgtggccacatctctcaaaagcccctcacagccccaggcaccaaaagacagaaaggtccccaccaggaaggccgagaggtcggtcagctgcattga

SEQ ID NO: 6877 - DNA, 163 bp, synthetic construct; identical to SEQ ID NO: 480
  misc_feature 1..163: note = Synthetic polypeptide
  source 1..163: mol_type = other DNA

SEQ ID NO: 6878 - DNA, 104 bp, synthetic construct; identical to SEQ ID NO: 481
  misc_feature 1..104: note = Synthetic polypeptide
  source 1..104: mol_type = other DNA

SEQ ID NO: 6879 - DNA, 310 bp, synthetic construct
  misc_feature 1..310: note = Synthetic polypeptide
  source 1..310: mol_type = other DNA
ggtcgggtgcggtggctcaagcctgtaatcccagcactttgggaggccgaggtgggcggatcacaaggttgcagagcctgaggcctgtgatcagatgtacgagagcttagcgcgactccattcaaactactacaaacacaagtaccctcgccccagagacaccagcttcagtggcctgtcgttggaagagtacaagctgatcctgtccacagacaccttggaagagcttaaggaaatagataaaggcatgtggaagaaactgcaggagaagtttgcccccaagggtcctgaggaggatcataaggcctga

SEQ ID NO: 6880 - DNA, 733 bp, synthetic construct
  misc_feature 1..733: note = Synthetic polypeptide
  source 1..733: mol_type = other DNA
ggccaggtgcagtggctcacgcctgtaatcccagcactttgggaggccaaggtgggcggatcacttgagaccaggagtttgagacaagcctggccaagatgccaagtatcttcaagaccttctcatggagagtgtgaatttttcccccgccaatctctctagcactggttccaggtatctgaatgctttggttgacagtgcggtggcccttgaaacaaaggatacctcgctagctagttttatccctgcagtgaatgatttgacctctgatctctttcgtaccaaatccaaaagtgaagaaatcaagattgaactggaaaaacttgaaaaaaatttaactgcaactttagtattagaaaaatgtctacaagaggatgtcaagaaagcagagttgcatctgtctacagaaagggccaaagttgataatcgtcgtcagaacatggactttctaaaagcaaagtcagaggaattcagatttggaatcaaggctgcagaggagcaactttcagccagaggcatggatgcttctctgtctcatcagtccttagtagcactatcagagaaactggcaagattaaagcaacagactatacctttgaagaaaaaattggagtcctatttagacttaatgccgaatccgtctcttgctcaagtgaaaattgaagaagcaaagcgagaactagatagcattgaagctgaacttacaagaagagtagacatgatggaactgtga

SEQ ID NO: 6881 - DNA, 273 bp, synthetic construct
  misc_feature 1..273: note = Synthetic polypeptide
  source 1..273: mol_type = other DNA
ggccaggtgcagtggctcacgcctgtaatcccagcactttgggaggccaaggtgggcggatcacttgagaccaggagtttgagacaagcctggccaagatgccaagtatcttcaagaccttctcatggagagtgtgaatttttcccccgccaatctctctagcactggttccaggtatctgaatgctttggttgacagtgcggtggcccttgaaacaaaggatacctcgctagctagttttatccctgcagtgaatgatttgacctctgatct

SEQ ID NO: 6882 - DNA, 408 bp, synthetic construct
  misc_feature 1..408: note = Synthetic polypeptide
  source 1..408: mol_type = other DNA
attgtaatagagtaagtaaatatttggtctttgtcccagttcttggcacagagctctccaaaaacactcggagtttgcagagtgctaggagtgtctttgtcgttcctagtgatccactttggaccacacctgagtttgttctactgtgaggtgattttggtggggcccctagatagcctcatagttggtttagtcagaaaggccaatcacttgatttgagggttaaaacttgtcggcccacttgccaaccttggggttgcagggccagagattgaactctataaaaactcctaatttgatgtgcttctggattggtgaacaactcgacatactgggcagagaacatttataatgatgaagaccctgaaggaagcgtggatccagaaggacaagggagttagtccttga

SEQ ID NO: 6883 - DNA, 401 bp, synthetic construct
  misc_feature 1..401: note = Synthetic polypeptide
  source 1..401: mol_type = other DNA
attgtaatagagtaagtaaatatttggtctttgtcccagttcttggcacagagctctccaaaaacactcggagtttgcagagtgctaggagtgtctttgtcgttcctagtgatccactttggaccacacctgagtttgttctactgtgaggtgattttggtggggcccctagatagcctcatagttggtttagtcagaaaggccaatcacttgatttgagggttaaaacttgtcggcccacttgccaaccttggggttgcagggccagagattgaactctataaaaactcctaatttgatgtgcttctggattggtgaacaactcgacatactgggcagagaacatttataatgatgaagaccctgaaggaagcgtggatccagaaggacaagggtcctag

SEQ ID NO: 6884 - DNA, 510 bp, synthetic construct
  misc_feature 1..510: note = Synthetic polypeptide
  source 1..510: mol_type = other DNA
attgtaatagagtaagtaaatatttggtctttgtcccagttcttggcacagagctctccaaaaacactcggagtttgcagagtgctaggagtgtctttgtcgttcctagtgatccactttggaccacacctgagtttgttctactgtgaggtgattttggtggggcccctagatagcctcatagttggtttagtcagaaaggccaatcacttgatttgagggttaaaacttgtcggcccacttgccaaccttggggttgcagggccagagattgaactctataaaaactcctaatttgatgtgcttctggattggtgaacaactcgacatactgggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataa

SEQ ID NO: 6885 - DNA, 1883 bp, synthetic construct; identical to SEQ ID NO: 6345
  misc_feature 1..1883: note = Synthetic polypeptide
  source 1..1883: mol_type = other DNA

SEQ ID NO: 6886 - DNA, 39 bp, synthetic construct
  misc_feature 1..39: note = Synthetic polypeptide
  source 1..39: mol_type = other DNA
ggccaggaagcagaagtgcaagcaaagcagcaagcatga

SEQ ID NO: 6887 - DNA, 2477 bp, synthetic construct
  misc_feature 1..2477: note = Synthetic polypeptide
  source 1..2477: mol_type = other DNA
tgtcagggaagcaggagcccgggagagccagggtgacacccttttaaaatcaactccgtcgtaaaattagcaaggcacactctttgccagtcaacccacggtcctgagatgtttacggcagaggaagcatcttgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaa

SEQ ID NO: 6888 - DNA, 2399 bp, synthetic construct
  misc_feature 1..2399: note = Synthetic polypeptide
  source 1..2399: mol_type = other DNA
tgtcagggaagcaggagcccgggagagccagggtgacacccttttaaaatcaactccgtcgtaaaattagcaaggcacactctttgccagtcaacccacggtcctgagatgtttacggcagaggaagcatcttgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaa

SEQ ID NO: 6889 - DNA, 2672 bp, synthetic construct
  misc_feature 1..2672: note = Synthetic polypeptide
  source 1..2672: mol_type = other DNA
tgtcagggaagcaggagcccgggagagccagggtgacacccttttaaaatcaactccgtcgtaaaattagcaaggcacactctttgccagtcaacccacggtcctgagatgtttacggcagaggaagcatcttgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgttacctggaagactggccaggtggaacgaggcagggcctggaagccaccagcctctctcgccctctgtagcaggagctgcgactctatggtttcatgttacgcttccattctgtgcaaggctctgtggaaggagaagctgcacacattctggcatcataacagaatttcatttcttccatctgcattcaggccaataccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaa

SEQ ID NO: 6890 - DNA, 2267 bp, synthetic construct
  misc_feature 1..2267: note = Synthetic polypeptide
  source 1..2267: mol_type = other DNA
tgtcagggaagcaggagcccgggagagccagggtgacacccttttaaaatcaactccgtcgtaaaattagcaaggcacactctttgccagtcaacccacggtcctgagatgtttacggcagaggaagcatcttgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaaggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaa

SEQ ID NO: 6891 - DNA, 2114 bp, synthetic construct
  misc_feature 1..2114: note = Synthetic polypeptide
  source 1..2114: mol_type = other DNA
tgtcagggaagcaggagcccgggagagccagggtgacacccttttaaaatcaactccgtcgtaaaattagcaaggcacactctttgccagtcaacccacggtcctgagatgtttacggcagaggaagcatcttgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtga

SEQ ID NO: 6892 - DNA, 359 bp, synthetic construct
  misc_feature 1..359: note = Synthetic polypeptide
  source 1..359: mol_type = other DNA
tgtcagggaagcaggagcccgggagagccagggtgacacccttttaaaatcaactccgtcgtaaaattagcaaggcacactctttgccagtcaacccacggtcctgagatgtttacggcagaggaagcatcttgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcaggccatgaaggacctgtttatgcggtgcatgctgtttaccagaggaggacatcagatcctgcattatgtacactga

SEQ ID NO: 6893 - DNA, 2462 bp, synthetic construct
  misc_feature 1..2462: note = Synthetic polypeptide
  source 1..2462: mol_type = other DNA
tgtcagggaagcaggagcccgggagagccagggtgacacccttttaaaatcaactccgtcgtaaaattagcaaggcacactctttgccagtcaacccacggtcctgagatgtttacggcagaggaagcatcttgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagttacctggaagactggccaggtggaacgaggcagggcctggaagccaccagcctctctcgccctctgtagcaggagctgcgactctatggtttcatgttacgcttccattctgtgcaaggctctgtggaaggagaagctgcacacattctggcatcataacagaatttcatttcttccatctgcattcaggccaataccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacagagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaa

SEQ ID NO: 6894 - DNA, 2267 bp, synthetic construct
  misc_feature 1..2267: note = Synthetic polypeptide
  source 1..2267: mol_type = other DNA
tgtcagggaagcaggagcccgggagagccagggtgacacccttttaaaatcaactccgtcgtaaaattagcaaggcacactctttgccagtcaacccacggtcctgagatgtttacggcagaggaagcatcttgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacagagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaa

SEQ ID NO: 6895 - DNA, 302 bp, synthetic construct
  misc_feature 1..302: note = Synthetic polypeptide
  source 1..302: mol_type = other DNA
tgtcagggaagcaggagcccgggagagccagggtgacacccttttaaaatcaactccgtcgtaaaattagcaaggcacactctttgccagtcaacccacggtcctgagatgtttacggcagaggaagcatcttgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagatatgggcacggttatga

SEQ ID NO: 6896 - DNA, 427 bp, synthetic construct; identical to SEQ ID NO: 573
  misc_feature 1..427: note = Synthetic polypeptide
  source 1..427: mol_type = other DNA

SEQ ID NO: 6897 - DNA, 696 bp, synthetic construct
  misc_feature 1..696: note = Synthetic polypeptide
  source 1..696: mol_type = other DNA
ggccgggcacggtggctcctgcctctaatcccagcactttgggaggccaaggcgggcagattacctgaggtcgggagtttgagatcagcctgaccaacatggagaaaccccatctctatcaaaaaacaaaattagccgagtgtggtgacgcatgcctgtaatcccagctgcttgggaggctgaggcagaagaatcgcttgaacccgggaagcggaagttgtgattcgggaactggagcctctcctctgtcacagtgacaatccatctcagctcatctggacatcatctcgcagtgcaaggaaatctaatttcagcctcgaggacttccagcacagcaaaggcaaggaaccctacagctcttccaaatatgccactgaccttttgagtgtggctttgaacaggaacttcaaccagcagcttcgcttttttgcaaatgcattcactttgacaccatataatggaacagaagctctggtatggcttttccaccaaaagcctgaatctctcaatcctctgatcaaatatctgagtgccaccactggctttggaagaaattacattatgacccagaagatggacctagatgaagacactgctgaaaaattttatcaaaagttactggaactggaaaagcacattagggtcactattcaaaaaacagataatcaggccaggctcagtggctcatgcctataa

SEQ ID NO: 6898 - DNA, 801 bp, synthetic construct
  misc_feature 1..801: note = Synthetic polypeptide
  source 1..801: mol_type = other DNA
ggccgggcacggtggctcctgcctctaatcccagcactttgggaggccaaggcgggcagattacctgaggtcgggagtttgagatcagcctgaccaacatggagaaaccccatctctatcaaaaaacaaaattagccgagtgtggtgacgcatgcctgtaatcccagctgcttgggaggctgaggcagaagaatcgcttgaacccgggaagcggaagttgtgattcgggaactggagcctctcctctgtcacagtgacaatccatctcagctcatctggacatcatctcgcagtgcaaggaaatctaatttcagcctcgaggacttccagcacagcaaaggcaaggaaccctacagctcttccaaatatgccactgaccttttgagtgtggctttgaacaggaacttcaaccagcagggtctctattccaatgtggcctgtccaggtacagcattgaccaatttgacatatggaattctgcctccgtttatatggacgctgttgatgccggcaatattgctacttcgcttttttgcaaatgcattcactttgacaccatataatggaacagaagctctggtatggcttttccaccaaaagcctgaatctctcaatcctctgatcaaatatctgagtgccaccactggctttggaagaaattacattatgacccagaagatggacctagatgaagacactgctgaaaaattttatcaaaagttactggaactggaaaagcacattagggtcactattcaaaaaacagataatcaggccaggctcagtggctcatgcctataa

SEQ ID NO: 6899 - DNA, 128 bp, synthetic construct
  misc_feature 1..128: note = Synthetic polypeptide
  source 1..128: mol_type = other DNA
acaacaacaaaaagaaatgtagagtgccaggcccactgcagacctactgaatcagagcctgaattttaagataccccgcagatgagcaggagactaaagatgcagcagaagaatgtaaagaaccctaa

SEQ ID NO: 6900 - DNA, 3055 bp, synthetic construct; identical to SEQ ID NO: 709
  misc_feature 1..3055: note = Synthetic polypeptide
  source 1..3055: mol_type = other DNA

SEQ ID NO: 6901 - DNA, 3058 bp, synthetic construct; identical to SEQ ID NO: 710
  misc_feature 1..3058: note = Synthetic polypeptide
  source 1..3058: mol_type = other DNA

SEQ ID NO: 6902 - DNA, 343 bp, synthetic construct; identical to SEQ ID NO: 891
  misc_feature 1..343: note = Synthetic polypeptide
  source 1..343: mol_type = other DNA

SEQ ID NO: 6903 - DNA, 218 bp, synthetic construct
  misc_feature 1..218: note = Synthetic polypeptide
  source 1..218: mol_type = other DNA
cgaagccgggtgggctgcgggaccctcgagaacccagctggcttcggagtgagctggcccggggctggtacccgctgcgctttttcacagccattgtgaccttgtttcgtgtggctgatcaaagaaagaaggcatacgcagatttctacagaaactacgatgtcatgaaagattttgaggagatgaggaaggctggtatctttcagagtgtaaagtaa

SEQ ID NO: 6904 - DNA, 812 bp, synthetic construct; identical to SEQ ID NO: 693
  misc_feature 1..812: note = Synthetic polypeptide
  source 1..812: mol_type = other DNA

SEQ ID NO: 6905 - DNA, 752 bp, synthetic construct; identical to SEQ ID NO: 694
  misc_feature 1..752: note = Synthetic polypeptide
  source 1..752: mol_type = other DNA

SEQ ID NO: 6906 - DNA, 156 bp, synthetic construct
  misc_feature 1..156: note = Synthetic polypeptide
  source 1..156: mol_type = other DNA
gctgggcatggtgacacacacctgtcatcccagctacttgtgagcccaaggcaggaggattgcttgagcccaggaattgaaggccaaccggggtacacaacaaaacatttgaatgatgagactacctccaagcaaattaaatccatgctgcaataa

SEQ ID NO: 6907 - DNA, 177 bp, synthetic construct
  misc_feature 1..177: note = Synthetic polypeptide
  source 1..177: mol_type = other DNA
tagttaaggggttgagctctggagtcaacgtgtggaccccaacccctctgttaaccagctgtggacactcaaggtccaaacaccctagatgatctctttcaagaactggacaagaatggagatggagaagttagttttgaagaattccaagtattagtaaaaaagatatcccagtga

SEQ ID NO: 6908 - DNA, 472 bp, synthetic construct
  misc_feature 1..472: note = Synthetic polypeptide
  source 1..472: mol_type = other DNA
gtggtggctcacgcctgtaataccggcactttgggaggccgaggcaggtggatcacttgagtctgcagccaggagagcagggacgtcctgtgcgaactgtcagaccaccacaaccacactctggaggaggaatgccaatggggaccctgtctgcaatgcctgtgggctctactacaagcttcacaatattaacagacccctgactatgaagaaggaaggcatccagaccagaaaccgaaaaatgtctagcaaatccaaaaagtgcaaaaaagtgcatgactcactggaggacttccccaagaacagctcgtttaacccggccgccctctccagacacatgtcctccctgagccacatctcgcccttcagccactccagccacatgctgaccacgcccacgccgatgcacccgccatccagcctgtcctttggaccacaccacccctccagcatggtcaccgccatgggttag

SEQ ID NO: 6909 - DNA, 360 bp, synthetic construct
  misc_feature 1..360: note = Synthetic polypeptide
  source 1..360: mol_type = other DNA
tggtcccagccctcatggcctcactgtatgactaacagctccatgcctcggtttcctcacctgtaaagtgaggattgcagtagcgctcaccctttcaagttgttgaggttacctgagtccgggtgtgtgcctctctcgccaggcccaggagaccatggtgagagcaccagcaagctggccagtgtgacccgcagcgtggacaaggaccctgggatccccagagctctaagcctcagtggctcctccagctcaccccaagcccaggtgatggtgcacatggcaaaccccagacagcccctgcctgcctctgggctggccacaggaatgccacaacagcccgcagcatatgccctagggtga

SEQ ID NO: 6910 - DNA, 280 bp, synthetic construct
  misc_feature 1..280: note = Synthetic polypeptide
  source 1..280: mol_type = other DNA
tggtcccagccctcatggcctcactgtatgactaacagctccatgcctcggtttcctcacctgtaaagtgaggattgcagtagcgctcaccctttcaagttgttgaggttacctgagtccgggtgtgtgcctctctcgccaggcccaggagaccatggtgagagcaccagcaagctggccagtgtgacccgcagcgtggacaaggaccctgggatccccagagctctaagcctcagtggctcctccagctcaccccaagcccaggtgatggtgcacatgg

SEQ ID NO: 6911 - DNA, 3127 bp, synthetic construct
  misc_feature 1..3127: note = Synthetic polypeptide
  source 1..3127: mol_type = other DNA
gaggaggaagaggaagaggcgaaggctggcggaggaggagagaccagatgaagaagctgtggtggatcagggtgggaccagtacaattctcaacattcactatgaaaaagaagagctggaaggtcacagaactctgtatgtgggagttcggatgccgcttggccggcagagccatcggcatcaccgcactcatggccagaagcaccggagacgagggcggggcaaaggagccagccagggggaggaaggcctggaagccctggcccacgacacaccatctcagcgtgttcagttcattcttggcaccgaggaagatgaagagcatgtgcctcatgagctgtttacagagctggatgagatctgtatgaaagagggagaagatgctgagtggaaggaaacagccaggtggctgaagtttgaagaagatgttgaagatgggggagaacgctggagcaagccttatgtggcaaccctttcattgcacagcctgtttgagctaaggagctgccttattaatggaacagtcctcctggatatgcatgcaaatagcatagaagaaatttcagacctgatcctggatcagcaagaactgtccagtgacctgaatgacagcatgagggttaaagtgcgggaagcccttctcaaaaagcatcatcatcagaatgaaaagaagagaaacaacctcattcccattgttcgctcctttgctgaggttggcaagaagcagtctgatcctcatttgatggataaacatggtcaaaccgtgtctcctcagtctgttccaactacaaatcttgaagtaaaaaatggagtgaattgtgaacatagtcctgtggatttaagcaaggtagaccttcatttcatgaaaaaaattcctactggggccgaggcctccaatgtcctggttggagaggtggatattttggaccgtcccattgttgcctttgtgaggctgtctccagctgttcttctctcaggcctaacagaagtgccaatcccaacaagatttttgtttatcttattgggtccagtagggaaaggtcagcagtaccatgagattggcagatccatggccaccatcatgacagatgagatttttcatgacgtagcatataaggcaaaagagcgagatgatctcctggcggggattgatgagttcctagaccaggtgacggtgctccctccaggagagtgggatccctccattagaattgagccacccaaaaatgtcccttcccaggagaaaaggaaaatgcctggagttccaaatggaaatgtttgccacatagaacaggaaccacatgggggtcacagtgggccagaacttcagcgcactgggcggctatttgggggcttggtgctggacatcaagcggaaggccccctggtactggagcgactaccgagatgcactcagcttacagtgtttggcttcctttctgttcctgtactgtgcctgcatgtcacctgtcatcacctttgggggactgcttggagaagccactgagggacgcataagtgcaattgaatccttgtttggagcttccatgactgggattgcttattccttgtttgcgggacaggctctcaccatcctgggaagtactggaccagtgcttgtgtttgaaaagattttgttcaaattctgcaaagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcagagacctaccccatccacatgcacagccagctggaccaccttagcctctattactgcaggtgtactctgccagagaatccaaacaatcacaccctccagtactggaaggaccacaacatcgtgacagcagaagtccactgggctaacctgactgtcagtgaatgccaggagatgcatggagagttcatgggatctgcgtgcggccatcatggaccctacactcctgatgtcctcttttggtcctgtattctctttttcaccaccttcatcctctcaagcaccttaaagacgtttaagacgagccgttatttcccaaccagagtacgctccatggtgagtgactttgctgttttcctcactatcttcacaatggtgattattgattttttgattggagtcccatcaccaaagcttcaagttcccagtgtgttcaagccaacaagggatgatcgcggatggattattaatcccattggccccaatccctggtggactgtgatagctgcaattatcccagctcttctctgtactatcttgatattcatggatcagcagatcacagccgtcattattaacaggaaggaacataagctcaagaaaggctgtggctaccacctggacctactgatggtggccatcatgctgggtgtctgctccatcatgggcctgccctggtttgtagctgcaactgtcttgtccatcacacatgtgaacagcctcaagctagaatctgaatgctctgctcctggagaacagcccaagttcctgggcatccgagaacagagagtgacaggccttatgatctttgtgctgatgggctgctcagtcttcatgacggctatcttaaagtttattccaatgccagtactctacggagttttcctttacatgggagtttcttcactacagggaattcagttctttgatcgtctaaagctctttgggatgcccgcaaagcaccagccagatttcatctacctgcggcatgtgccgctgcgcaaagtgcacctcttcaccctcatccagttgacctgtctcgtcctgctctgggtcatcaaggcatctccagctgccattgttttcccaatgatggttttggccttggtctttgtcaggaaagtcatggatctctgtttctctaagcgagagctgagctggctagatgatctcatgcctgaaagcaaaaagaagaagttggatgatgccaaaaagaaggccaaggaggaagaggtcatagtccttgcaccaactgtatacctgggggcctcaaattacagaacatag

SEQ ID NO: 6912 - DNA, 3274 bp, synthetic construct
  misc_feature 1..3274: note = Synthetic polypeptide
  source 1..3274: mol_type = other DNA
gaggaggaagaggaagaggcgaaggctggcggaggaggagagaccagatgaagaagctgtggtggatcagggtgggaccagtacaattctcaacattcactatgaaaaagaagagctggaaggtcacagaactctgtatgtgggagttcggatgccgcttggccggcagagccatcggcatcaccgcactcatggccagaagcaccggagacgagggcggggcaaaggagccagccagggggaggaaggcctggaagccctggcccacgacacaccatctcagcgtgttcagttcattcttggcaccgaggaagatgaagagcatgtgcctcatgagctgtttacagagctggatgagatctgtatgaaagagggagaagatgctgagtggaaggaaacagccaggtggctgaagtttgaagaagatgttgaagatgggggagaacgctggagcaagccttatgtggcaaccctttcattgcacagcctgtttgagctaaggagctgccttattaatggaacagtcctcctggatatgcatgcaaatagcatagaagaaatttcagacctgatcctggatcagcaagaactgtccagtgacctgaatgacagcatgagggttaaagtgcgggaagcccttctcaaaaagcatcatcatcagaatgaaaagaagagaaacaacctcattcccattgttcgctcctttgctgaggttggcaagaagcagtctgatcctcatttgatggataaacatggtcaaaccgtgtctcctcagtctgttccaactacaaatcttgaagtaaaaaatggagtgaattgtgaacatagtcctgtggatttaagcaaggtagaccttcatttcatgaaaaaaattcctactggggccgaggcctccaatgtcctggttggagaggtggatattttggaccgtcccattgttgcctttgtgaggctgtctccagctgttcttctctcaggcctaacagaagtgccaatcccaacaagatttttgtttatcttattgggtccagtagggaaaggtcagcagtaccatgagattggcagatccatggccaccatcatgacagatgagatttttcatgacgtagcatataaggcaaaagagcgagatgatctcctggcggggattgatgagttcctagaccaggtgacggtgctccctccaggagagtgggatccctccattagaattgagccacccaaaaatgtcccttcccaggagaaaaggaaaatgcctggagttccaaatggaaatgtttgccacatagaacaggaaccacatgggggtcacagtgggccagaacttcagcgcactgggcggctatttgggggcttggtgctggacatcaagcggaaggccccctggtactggagcgactaccgagatgcactcagcttacagtgtttggcttcctttctgttcctgtactgtgcctgcatgtcacctgtcatcacctttgggggactgcttggagaagccactgagggacgcataagtgcaattgaatccttgtttggagcttccatgactgggattgcttattccttgtttgcgggacaggctctcaccatcctgggaagtactggaccagtgcttgtgtttgaaaagattttgttcaaattctgcaaagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcagagacctaccccatccacatgcacagccagctggaccaccttagcctctattactgcaggtgtactctgccagagaatccaaacaatcacaccctccagtactggaaggaccacaacatcgtgacagcagaagtccactgggctaacctgactgtcagtgaatgccaggagatgcatggagagttcatgggatctgcgtgcggccatcatggaccctacactcctgatgtcctcttttggtcctgtattctctttttcaccaccttcatcctctcaagcaccttaaagacgtttaagacgagccgttatttcccaaccagagtacgctccatggtgagtgactttgctgttttcctcactatcttcacaatggtgattattgattttttgattggagtcccatcaccaaagcttcaagttcccagtgtgttcaagccaacaagggatgatcgcggatggattattaatcccattggccccaatccctggtggactgtgatagctgcaattatcccagctcttctctgtactatcttgatattcatggatcagcagatcacagccgtcattattaacaggaaggaacataagctcaagaaaggctgtggctaccacctggacctactgatggtggccatcatgctgggtgtctgctccatcatgggcctgccctggtttgtagctgcaactgtcttgtccatcacacatgtgaacagcctcaagctagaatctgaatgctctgctcctggagaacagcccaagttcctgggcatccgagaacagagagtgacaggccttatgatctttgtgctgatgggctgctcagtcttcatgacggctatcttaaagtttattccaatgccagtactctacggagttttcctttacatgggagtttcttcactacagggaattcagttctttgatcgtctaaagctctttgggatgcccgcaaagcaccagccagatttcatctacctgcggcatgtgccgctgcgcaaagtgcacctcttcaccctcatccagttgacctgtctcgtcctgctctgggtcatcaaggcatctccagctgccattgttttcccaatgatggttttggccttggtctttgtcaggaaagtcatggatctctgtttctctaagcgagagctgagctggctagatgatctcatgcctgaaagcaaaaagaagaagttggatgatgccaaaaagaaggccaaggaggaagaggaggctgagaaaatgttagaaattgggggagacaagtttcccttagagagcaggaagttactaagtagtcctggaaagaacatcagttgcagatgtgacccctctgagattaatatatctgatgaaatgcctaaaactacagtttggaaagctctcagtatgaattctggaaatgcaaaggaaaagagtctcttcaactaa

SEQ ID NO: 6913 - DNA, 1389 bp, synthetic construct; identical to SEQ ID NO: 863
  misc_feature 1..1389: note = Synthetic polypeptide
  source 1..1389: mol_type = other DNA

SEQ ID NO: 6914 - DNA, 1012 bp, synthetic construct
  misc_feature 1..1012: note = Synthetic polypeptide
  source 1..1012: mol_type = other DNA
gagaggtgggaagagggagagaaaagtatgagaaagacaaataaacaggctgaggtagacaatgggtgacacagaaaggaagtgagacagagactaagagagatagaaaggagagaggcagggagatggggcagaggccaagaaaaagacagaaggatgagggaggaagatgcagaaagagctgtttgagctcttctctggcttcttgaaatactttcctggggcacacaggcaagtttacaaaaacctgcaggaaatcaatgcttacattggccacagtgtggagaagcaccgtgaaaccctggaccccagcgcccccaaggacctcatcgacacctacctgctccacatggaaaaagagaaatccaacgcacacagtgaattcagccaccagaacctcaacctcaacacgctctcgctcttctttgctggcactgagaccaccagcaccactctccgctacggcttcctgctcatgctcaaataccctcatgttgcagagagagtctacagggagattgaacaggtgattggcccacatcgccctccagagcttcatgaccgagccaaaatgccatacacagaggcagtcatctatgagattcagagattttccgaccttctccccatgggtgtgccccacattgtcacccaacacaccagcttccgagggtacatcatccccaaggacacagaagtatttctcatcctgagcactgctctccatgacccacactactttgaaaaaccagacgccttcaatcctgaccactttctggatgccaatggggcactgaaaaagactgaagcttttatccccttctccttagggaagcggatttgtcttggtgaaggcatcgcccgtgcggaattgttcctcttcttcaccaccatcctccagaacttctccatggccagccccgtggccccagaagacatcgatctgacaccccaggagtgtggtgtgggcaaaatacccccaacataccagatccgcttcctgccccgctga

SEQ ID NO: 6915 - DNA, 131 bp, synthetic construct
  misc_feature 1..131: note = Synthetic polypeptide
  source 1..131: mol_type = other DNA
gtggcctagtggttaggaacatgggttctgggtagggaagacctgggtttgaatccttgctctgctgctagatggagatcttagatgagcaggagactaaagatgcagcagaagaatgtaaagaaccctaa

SEQ ID NO: 6916 - DNA, 456 bp, synthetic construct; identical to SEQ ID NO: 6649
  misc_feature 1..456: note = Synthetic polypeptide
  source 1..456: mol_type = other DNA

SEQ ID NO: 6917 - DNA, 480 bp, synthetic construct; identical to SEQ ID NO: 6650
  misc_feature 1..480: note = Synthetic polypeptide
  source 1..480: mol_type = other DNA

SEQ ID NO: 6918 - DNA, 186 bp, synthetic construct; identical to SEQ ID NO: 6651
  misc_feature 1..186: note = Synthetic polypeptide
  source 1..186: mol_type = other DNA

SEQ ID NO: 6919 - DNA, 440 bp, synthetic construct
  misc_feature 1..440: note = Synthetic polypeptide
  source 1..440: mol_type = other DNA
tgatatgttttgaatttgtgtccctacccaaatatcatgtcaaattgtcatccctaatgttggaggaggggcctggtgagaggtgattggatcacagggagggacttccccttgcttttctctcaataatgagttctcacaagatctggttcttcagaagtgtgtggcacctcccctactctctctttctccttctccggccatgcaagacatatctgcttctccttcaccttccactatgattgctggagtgcagtggttcaatcacggatcactgcagcctccacctcccagttcaagaaattctcatgtctcagcctcctgagcagctaggattacagacaaaccttggaaatcaagaaagttctggaatgatgaagctgttcatgccaagaccgaaagtgctggcccagtatgagtccattcagttcatgccgtga

SEQ ID NO: 6920 - DNA, 1737 bp, synthetic construct; identical to SEQ ID NO: 905
  misc_feature 1..1737: note = Synthetic polypeptide
  source 1..1737: mol_type = other DNA

SEQ ID NO: 6921 - DNA, 284 bp, synthetic construct; identical to SEQ ID NO: 906
  misc_feature 1..284: note = Synthetic polypeptide
  source 1..284: mol_type = other DNA

SEQ ID NO: 6922 - DNA, 856 bp, synthetic construct; identical to SEQ ID NO: 907
  misc_feature 1..856: note = Synthetic polypeptide
  source 1..856: mol_type = other DNA

SEQ ID NO: 6923 - DNA, 802 bp, synthetic construct; identical to SEQ ID NO: 908
  misc_feature 1..802: note = Synthetic polypeptide
  source 1..802: mol_type = other DNA

SEQ ID NO: 6924 - DNA, 561 bp, synthetic construct; identical to SEQ ID NO: 909
  misc_feature 1..561: note = Synthetic polypeptide
  source 1..561: mol_type = other DNA

SEQ ID NO: 6925 - DNA, 582 bp, synthetic construct; identical to SEQ ID NO: 910
  misc_feature 1..582: note = Synthetic polypeptide
  source 1..582: mol_type = other DNA

SEQ ID NO: 6926 - DNA, 1261 bp, synthetic construct
  misc_feature 1..1261: note = Synthetic polypeptide
  source 1..1261: mol_type = other DNA
tcatgatttgatttaaatgtgacatcctttcttagagaagttttctttgtctccttcttccccagtcacttcctcccatccactgtgctttcggcagttcattcgttcattaattcattcaacgaatattgaataacttttgatcaatgtcttcctccctccaagctgaaaacttgatggagggtaacatgatctgtctttgtttaccactgcatcttccgtgaatatacattggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagcccccgatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacggtctga

SEQ ID NO: 6927 - DNA, 925 bp, synthetic construct
  misc_feature 1..925: note = Synthetic polypeptide
  source 1..925: mol_type = other DNA
tcatgatttgatttaaatgtgacatcctttcttagagaagttttctttgtctccttcttccccagtcacttcctcccatccactgtgctttcggcagttcattcgttcattaattcattcaacgaatattgaataacttttgatcaatgtcttcctccctccaagctgaaaacttgatggagggtaacatgatctgtctttgtttaccactgcatcttccgtgaatatacattggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagcccccgatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggtatctcacatgtagaagcaaagaagagaatcctgaacttgcatcctaaaatatttggaaacaagtggtttcctcgtgtctaa

SEQ ID NO: 6928 - DNA, 1775 bp, synthetic construct; identical to SEQ ID NO: 568
  misc_feature 1..1775: note = Synthetic polypeptide
  source 1..1775: mol_type = other DNA

SEQ ID NO: 6929 - DNA, 877 bp, synthetic construct
  misc_feature 1..877: note = Synthetic polypeptide
  source 1..877: mol_type = other DNA
ggccaggccccgtggctcatgcttgtaatgcactttgggaggccaaggcaggcagatggcttgagctgaggagttcacgaccagcctgggcaacatagtgagacctcatctctacaaaacataaacaaaaacttagccagatgcagcaaatattttggtgatgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggcaccgtataaacttgagttcagacttcctgattactcctgatttctactgggacagagaaaacctggaaggactttacgataaaacgtgtcaattccttagcattggccgaagagttaaggtcatgaatgaaaaacttcagcactgcatggaactaacagatctaatgcggaatcacctgaatgagaagagggcactccgcttggagtggatgattgtcatcctcattaccatagaggtaatgtttgagctgggacgagtatttttctga

SEQ ID NO: 6930 - DNA, 670 bp, synthetic construct
  misc_feature 1..670: note = Synthetic polypeptide
  source 1..670: mol_type = other DNA
ggccaggccccgtggctcatgcttgtaatgcactttgggaggccaaggcaggcagatggcttgagctgaggagttcacgaccagcctgggcaacatagtgagacctcatctctacaaaacataaacaaaaacttagccagatgcagcaaatattttggtgatgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggcaccgtataaacttgagttcagacttcctgattactcctgatttctactgggacagagaaaac

SEQ ID NO: 6931 - DNA, 1385 bp, synthetic construct
  misc_feature 1..1385: note = Synthetic polypeptide
  source 1..1385: mol_type = other DNA
tgtgcatccgaatgatttttatccttttaagtcaccttgagagactgactgatttcagcggtgctgccattgctaaaaccatctttgaattatttggaacttctttcagagccagtttacatgcctcaaaatgaaaattagtcttcctgtatttttactcatttttgattaaaaaaaaagtttttatccaatttgatcacacacctcattctactgaaatcactccgagtgacttttggctgtttccaaaaataaattgactccaaaggatgaagatatgtgatcactgacaggaggtttaatgatgtgccataggttctgaagaaaattcctaaagaggaattccaaaagtgctctgagcaatggcagcgcccttggaataagggtgtagcttcccgaggtgactgactggctggaaggaggcagccatcatttggatgtttaaatactgtccaccaatcgattactttgatgtatttaaagaatcaaaagagcaaaatttctatgggtcacaggaatccatcattgctttatgtactcacctgcaacaattgataagaactattgaagacctagatgaaaatcagctgaaagatgagttttttaaacttctgcagatttcactgtggggaaataagtgtgatctgtctctctcaggtggagaaagtagttctcagaataccaatgtactaaattcattggaagacctaaaacctttcattttattgaatgatatggaacatctttggtcattgcttagcaattgcaagaaaacaagagaaaaagcttctgctactagagtgtatattgttctcgataattctggatttgagcttgttacagatttaatattagccgacttcttgttgtcctctgaactggctactgaggttcatttttatggaaaaacaattccatggtttgtttctgatactactatacatgattttaattggttaattgaacaggtaaaacacagtaatcataagtggatgtccaagtgtggggctgactgggaagagtatattaaaatgggtaaatgggtttaccacaatcatatattttggactctgcctcatgagtactgtgcaatgcctcaggttgcacctgacttatatgctgaactacagaaggcacatttaattttattcaagggtgatttgaattacaggaagttgacaggtgacagaaaatgggagttttctgttccatttcatcaggctctgaatggcttccatcctgcaccactctgtaccataagaacattaaaagctgaaattcaggttggtctgcagcctgggcaaggggaacagctcctggcctctgagcccagctggtggaccactggaaaatatggaatatttcagtacgatggtcccctttga

SEQ ID NO: 6932 - DNA, 285 bp, synthetic construct
  misc_feature 1..285: note = Synthetic polypeptide
  source 1..285: mol_type = other DNA
ctgggagattaactaaaacaccgagaacttgggagtggaatcaggcagccctttcagggtctcatgccaagactgccctgatacccgtgggcatcctagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctag

SEQ ID NO: 6933 - DNA, 333 bp, synthetic construct
  misc_feature 1..333: note = Synthetic polypeptide
  source 1..333: mol_type = other DNA
ctgggagattaactaaaacaccgagaacttgggagtggaatcaggcagccctttcagggtctcatgccaagactgccctgatacccgtgggcatcctagatgaagactggcccatttgcagagcactccaaccagctgtggaacatcagcgccgtcccttcctggtccaaagtgaaccagggtctcatccgcatgtataaggccgaggccagcccctctgacacttggggcctcggaatctcccatctggggcatgggcagtcagagaagcaccagccaccccagccccgaaaagctgcagtccagctctgtcctgatgagcttggaggctga

SEQ ID NO: 6934 - DNA, 207 bp, synthetic construct
  misc_feature 1..207: note = Synthetic polypeptide
  source 1..207: mol_type = other DNA
ctgggagattaactaaaacaccgagaacttgggagtggaatcaggcagccctttcagggtctcatgccaagactgccctgatacccgtgggcatcctagatgaagactggcccatttgcagagcactccaaccagctgtggaacatcagcgccgtcccttcctggtccaaagtgaaccagggtctcatccgcatgtataaggccgag

SEQ ID NO: 6935 - DNA, 555 bp, synthetic construct
  misc_feature 1..555: note = Synthetic polypeptide
  source 1..555: mol_type = other DNA
ctgggagattaactaaaacaccgagaacttgggagtggaatcaggcagccctttcagggtctcatgccaagactgccctgatacccgtgggcatcctagatgaagactggcccatttgcagagcactccaaccagctgtggaacatcagcgccgtcccttcctggtccaaagtgaaccagggtctcatccgcatgtataaggccgaggtgagtgggggctggccagtgtgcccgtccctgctgccgcacttggtcctgggctggggacaaagcaaaagatgtggaacctggggctcctgcttcctcctaccccactgttttgctctgaatcttaggccagcccctctgacacttggggcctcggaatctcccatctggggcatgggcagtcagagaagcaccagccaccccagccccgaaaagctgcagtccagctctgtcctgatgagcttggaggctgaggcaaggacctgctgcatggggagtgggggcgatgggggcctcccttctcctttatcaagtggccaaaggctcctcaaagctcgggcagtctga

SEQ ID NO: 6936 - DNA, 225 bp, synthetic construct
  misc_feature 1..225: note = Synthetic polypeptide
  source 1..225: mol_type = other DNA
ctgggagattaactaaaacaccgagaacttgggagtggaatcaggcagccctttcagggtctcatgccaagactgccctgatacccgtgggcatcctagatgaagactggcccatttgcagagcactccaaccagctgtggaacatcagcgccgtcccttcctggtccaaagtgaaccagggtctcatccgcatgtataaggccgaggctggcccttgtgactag

SEQ ID NO: 6937 - DNA, 275 bp, synthetic construct; identical to SEQ ID NO: 6546
  misc_feature 1..275: note = Synthetic polypeptide
  source 1..275: mol_type = other DNA

SEQ ID NO: 6938 - DNA, 1516 bp, synthetic construct; identical to SEQ ID NO: 534
  misc_feature 1..1516: note = Synthetic polypeptide
  source 1..1516: mol_type = other DNA

SEQ ID NO: 6939 - DNA, 591 bp, synthetic construct; identical to SEQ ID NO: 539
  misc_feature 1..591: note = Synthetic polypeptide
  source 1..591: mol_type = other DNA

SEQ ID NO: 6940 - DNA, 482 bp, synthetic construct; identical to SEQ ID NO: 540
  misc_feature 1..482: note = Synthetic polypeptide
  source 1..482: mol_type = other DNA

SEQ ID NO: 6941 - DNA, 444 bp, synthetic construct; identical to SEQ ID NO: 541
  misc_feature 1..444: note = Synthetic polypeptide
  source 1..444: mol_type = other DNA

SEQ ID NO: 6942 - DNA, 334 bp, synthetic construct; identical to SEQ ID NO: 533
  misc_feature 1..334: note = Synthetic polypeptide
  source 1..334: mol_type = other DNA

SEQ ID NO: 6943 - DNA, 38 bp, synthetic construct; identical to SEQ ID NO: 543
  misc_feature 1..38: note = Synthetic polypeptide
  source 1..38: mol_type = other DNA

SEQ ID NO: 6944 - DNA, 245 bp, synthetic construct; identical to SEQ ID NO: 542
  misc_feature 1..245: note = Synthetic polypeptide
  source 1..245: mol_type = other DNA

SEQ ID NO: 6945 - DNA, 1047 bp, synthetic construct
  misc_feature 1..1047: note = Synthetic polypeptide
  source 1..1047: mol_type = other DNA
ggctggacgtggtggctcatacctgtaatcccagcactttgggaggctgagttcaacagcatgatcctttactgtgtgcccaagctgcggctcatgggccagaagttcagcgtccgggagaagatggacatctcaggcctccaggtgcaggatatcgtcaagccaaacacagcacatacattcatcataacaggaagaaaaaggtccctggagctgcagacgcggacagaggaagagaagaaagaatggattcagatcatccaggccaccatcgagaagcacaaacagaacagcgaaaccttcaaggcttttggtggcgccttcagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagagaagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtga

SEQ ID NO: 6946 - DNA, 1044 bp, synthetic construct
  misc_feature 1..1044: note = Synthetic polypeptide
  source 1..1044: mol_type = other DNA
ggctggacgtggtggctcatacctgtaatcccagcactttgggaggctgagttcaacagcatgatcctttactgtgtgcccaagctgcggctcatgggccagaagttcagcgtccgggagaagatggacatctcaggcctccaggtgcaggatatcgtcaagccaaacacagcacatacattcatcataacaggaagaaaaaggtccctggagctgcagacgcggacagaggaagagaagaaagaatggattcagatcatccaggccaccatcgagaagcacaaacagaacagcgaaaccttcaaggcttttggtggcgccttcagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtga

SEQ ID NO: 6947 - DNA, 774 bp, synthetic construct
  misc_feature 1..774: note = Synthetic polypeptide
  source 1..774: mol_type = other DNA
ggctggacgtggtggctcatacctgtaatcccagcactttgggaggctgagttcaacagcatgatcctttactgtgtgcccaagctgcggctcatgggccagaagttcagcgtccgggagaagatggacatctcaggcctccaggtgcaggatatcgtcaagccaaacacagcacatacattcatcataacaggaagaaaaaggtccctggagctgcagacgcggacagaggaagagaagaaagaatggattcagatcatccaggccaccatcgagaagcacaaacagaacagcgaaaccttcaaggcttttggtggcgccttcagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagaggtgggtgctcccagctcctgctcccctcctggtggcgcggcagagcctccagacacctgctcctgtgccccagcagctccagctgcctctgctttcggagtgtccctgggaccaggatag

SEQ ID NO: 6948 - DNA, 1694 bp, synthetic construct
  misc_feature 1..1694: note = Synthetic polypeptide
  source 1..1694: mol_type = other DNA
ggccgggcacggtggctcacgcctgtaatcgcagcattttgggaggctgaagcaggtggatcacgaggtcaggagatggagaccatcctggccaacatggtgaagtcttcgtcttaaatgatggtggagaagttgatttagaccttggaaattatgaaagatttttggatattaatctttataaagacaacaatatcaccacggggaagatatatcagcatgtgatcaataaagagaggcgtggtgattacctggggaaaacagtgcaagttgtccctcacattactgatgctgtccaggagtgggttatgaatcaagccaaggtgccggtggatggtaataaggaagagccccaaatatgcgttattgagctgggaggcaccattggagacatcgaaggaatgccgtttgtggaggcgtttagacaattccagtttaaggcgaaaagagagaatttctgtaatatccacgttagccttgtcccacagctcagtgctaccggagaacaaaaaaccaaacccacccaaaacagcgtccgcgcactgaggggtttaggcctgtctccagatctgattgtctgccgaagttcaacgcccattgagatggccgtgaaggagaagatttctatgttttgtcacgtgaaccctgaacaggtcatatgtatccatgatgtttcttccacataccgagttcctgtgcttttagaggaacaaagcattgtgaaatattttaaggagagattgcacctgcccatcggtgattctgcaagtaatttgctttttaagtggagaaatatggctgacaggtatgaaaggttacagaaaatatgctccatagccctggttggcaaatacaccaagctcagagactgctacgcctctgtgttcaaagccctggaacactcagccctggccatcaaccacaagttgaatctgatgtacatagactccattgatctggagaagatcactgaaaccgaggaccctgtgaaatttcatgaagcttggcagaagctatgcaaagctgatggtattcttgtgcctggaggctttggaatcagaggaacattgggaaaactccaggcgatttcttgggcaaggacaaagaagattccttttctgggagtttgtcttgggatgcaactagcagtgatagagtttgcaagaaactgccttaacttgaaagatgctgattccacagagtttaggccaaatgccccagttcctctggtgattgatatgcccgagcacaaccctggcaatttgggaggaacaatgagactgggaataagaagaactgttttcaaaactgaaaattcaatattaaggaaactttatggtgatgttccttttatagaagaaagacacagacatcggttcgaggtaaaccctaacctgatcaaacaatttgagcagaatgacttaagttttgtaggtcaggatgttgatggagacaggatggaaatcattgaactggcaaatcatccttattttgttggtgtccagttccatcctgagttttcttctaggccgatgaagccttcccctccgtatctggggctgttacttgcagcaactgggaacctgaatgcctacttgcaacagggttgcaaactgtcttccagtgatagatacagtgatgccagtgatgacagcttttcagagccaaggatagctgagttggaaataagctga

SEQ ID NO: 6949 - DNA, 1498 bp, synthetic construct
  misc_feature 1..1498: note = Synthetic polypeptide
  source 1..1498: mol_type = other DNA
gggcaaacagctccaggccctcagagctgctcaaggcttttcaacccaggggatgataatcaatgttatgtcaatgaatcagccaaacagacagaaagatcacattatgttttctctgtttgaaaaggatgacaactggggagagaccaccacggccatcacaggcacctcggagcacagcatatcccaagaggacattgccaggatcagcaaggacatggaggacagcgtggggctggattgcaaacgctacctgggcctcaccgtcgcctcttttcttggacttctagttttcctcacccctattgccttcatccttttacctccgatcctgtggagggatgagctggagccttgtggcacaatttgtgaggggctctttatctccatggcattcaaactcctcattctgctcatagggacctgggcactttttttccgcaagcggagagctgacatgccacgggtgtttgtgtttcgtgcccttttgttggtcctcatctttctctttgtggtttcctattggcttttttacggggtccgcattttggactctcgggaccggaattaccagggcattgtgcaatatgcagtctcccttgtggatgccctcctcttcatccattacctggccatcgtcctgctggagctcaggcagctgcagcccatgttcacgctgcaggtggtccgctccaccgatggcgagtcccgcttctacagcctgggacacctgagtatccagcgagcagcattggtggtcctagaaaattactacaaagatttcaccatctataacccaaacctcctaacagcctccaaattccgagcagccaagcatatggccgggctgaaagtctacaatgtagatggccccagtaacaatgccactggccagtcccgggccatgattgctgcagctgctcggcgcagggactcaagccacaacgagttgtattatgaagaggccgaacatgaacggcgagtaaagaagcggaaagcaaggctggtggttgcagtggaagaggccttcatccacattcagcgtctccaggctgaggagcagcagaaagccccaggggaggtgatggaccctagggaggccgcccaggccattttcccctccatggccagggctctccagaagtacctgcgcatcacccggcagcagaactaccacagcatggagagcatcctgcagcacctggccttctgcatcaccaacggcatgacccccaaggccttcctagaacggtacctcagtgcgggccccaccctgcaatatgacaaggaccgctggctctctacacagtggaggcttgtcagtgatgaggctgtgactaatggattacgggatggaattgtgttcgtccttaagtgcttggacttcagcctcgtagtcaatgtgaagaaaattccattcatcatactctctgaagagttcatagaccccaaatctcacaaatttgtccttcgcttacagtctgagacatccgtttaa

SEQ ID NO: 6950 - DNA, 806 bp, synthetic construct
  misc_feature 1..806: note = Synthetic polypeptide
  source 1..806: mol_type = other DNA
ccacccaactcactctgtccatccctcaagactcactcaaagggatctataaagggcactgcttccggatcaatcacttcccagaggacaatgactacgaccacgacagctcggagtacctcctccgcatcgtgcgagcctccagcgtcttccccatcctcagcaccatcctgctcctgctgggtggcctgtgcatcggtgctggcaggatctacagccgcaagaacaacatcgtcctcagtgccggcatcctcttcgtggctgcaggcctcagtaacatcatcggtatcatcgtctacatttccagcaacacaggtgacccgagtgacaagcgggacgaagacaaaaagaaccattacaactacggctggtctttttactttggagctctgtctttcattgtggctgagaccgtgggcgtcctggctgtaaacatttacattgagaaaaataaagagttgaggtttaagaccaaacgggaattccttaaggcgtcttcctcttctccttatgccaggatgccgagctacaggtaccggcgacggcgctcgaggtccagctcaaggtccaccgaggcctcgccctccagggacgtgtcgcccatgggcctgaagatcacaggggccatccccatgggggagctgtccatgtacacgctgtccagggagcccctcaaggtgaccaccgcagccagctacagccccgaccaggaggccagcttcctgcaggtgcatgactttttccagcaggacctgaaggaaggtttccacgtcagcatgctgaaccgacggacgacccctgtgtga

SEQ ID NO: 6951 - DNA, 506 bp, synthetic construct
  misc_feature 1..506: note = Synthetic polypeptide
  source 1..506: mol_type = other DNA
cagcagttcttaacattgctgcatggtagaattacctgggaagctttaccaatttcaggcccttccttaggccaggtacttcagaacctcagagctccccagggggctccactccacagccaagggccatggtggcgtgttacccaggcaacgggctcgggtacgtaaggcacgttgacaatccccacggcgatgggcgctgcatcacctgtatctattacctgaatcagaactgggacgttaaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctag

SEQ ID NO: 6952 - DNA, 484 bp, synthetic construct
  misc_feature 1..484: note = Synthetic polypeptide
  source 1..484: mol_type = other DNA
agcagacaaggatggagatctgaagactcaaattgaaaagctctggacagaagtcaatgccttgaaggaaattcaagccctgcagacagtctgtctccgaggcactaaagttcacaagaaatgctaccttgcttcagaaggtttgaagcatttccatgaggccaatgaagactgcatttccaaaggaggaatcctggttatccccaggaactccgacgaaatcaacgccctccaagactatggtaaaaggagcctgccaggtgtcaatgacttttggctgggcatcaatgacatggtcacggaaggcaagtttgttgacgtcaacggaatcgctatctccttcctcaactgggaccgtgcacagcctaacggtggcaagcgagaaaactgtgtcctgttctcccaatcagctcagggcaagtggagtgatgaggcctgtcgcagcagcaagagatacatatgcgagttcaccatccctcaatag

SEQ ID NO: 6953 - DNA, 1052 bp, synthetic construct; identical to SEQ ID NO: 447
  misc_feature 1..1052: note = Synthetic polypeptide
  source 1..1052: mol_type = other DNA

SEQ ID NO: 6954 - DNA, 1118 bp, synthetic construct; identical to SEQ ID NO: 448
  misc_feature 1..1118: note = Synthetic polypeptide
  source 1..1118: mol_type = other DNA

SEQ ID NO: 6955 - DNA, 383 bp, synthetic construct
  misc_feature 1..383: note = Synthetic polypeptide
  source 1..383: mol_type = other DNA
gtggtggaatgttgtgatgtgccactcagatccttcttcaggaacaaaggaattatcatgtccatggctggcagagctgtccccaaaatagccatgagttatcagccacctcttggaactgccccaccagaagagaggcacctcgccaagctgaagctatgccatcttttatgtctgatgaggcagtttcatctgatttgaagatgatgaagaaaagttctttgcaaggttgcttattgaatattactgggaaaacaggaaaattaggaggaatgttctggagtgatttatctttttcatcaggggcccgcgttcagtccagccaccagatcaacacattctccaaactcattaactttggagaggctacccagagttcctga

SEQ ID NO: 6956 - DNA, 3278 bp, synthetic construct
  misc_feature 1..3278: note = Synthetic polypeptide
  source 1..3278: mol_type = other DNA
gtatatggtagacacacccgacagcaataatttaacttgagcataccctgaggatgatcctgtatggcagttgcacctgaatatgtgtttggagttcagagcgtgcccaacccagagataaattccttgtctgtgaggaacatctgagctctgggcccttcctgtggaacatcagcatacaggggagtgaggctctttgttttgcgttaaatgaaggttgccaggtggaggttgttaggaggagggagtgaagtgaaaatgctatataaactgcatgctttttgcatgcagtggtggttcttctgtccagcacatggctactgcatcatccctgtatgtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggatacaattatccatcagttgcagaaacgttatgcagacttgctaatttacacatatgttggagacatcttaattgccttaaaccccttccagaatctaagcatatactctccacagttttccagactttatcatggggtgaaacgcgcctccaatcccccccacatatttgcatcagcagatgctgcttaccagtgcatggttactctcagcaaagaccagtgcattgtcatcagcggagagagtggctctgggaagacagaaagcgcccacctgattgttcagcatttgactttcttgggaaaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgagagagaaaaattttcatatattttactatatttatgctggtcttcatcaccaaaagaagctttctgatttcagacttcctgaggaaaaacctcctaggtacatagctgatgaaactggaagggtgatgcacgacataacttccaaggagtcttacagaagacaattcgaagcaattcagcattgcttcaggattatagggttcacggacaaagaggtgcactcagtgtacagaattttggctgggattttgaatattgggaacattgagttcgcagctatttcctctcaacatcagactgataaaagtgaggtgcccaatgctgaagctttgcaaaatgctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatgtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcagatggaatatcagaatgaaggcattgatgctgtacccgtggaatatgaggacaaccgcccgctcttggacatgttcctccagaaacccctgggactgcttgcacttttggatgaggaaagtcggtttccccaagcaactgaccagaccctggttgataaatttgaagataatctacgatgcaaatacttctggaggcccaaaggagtggaactgtgctttggcattcagcattatgctggaaaggtattatatgatgcttctggggttcttgagaaaaatagagacactctccctgccgatgtggttgtggtcctgagaacgtcagaaaacaagcttcttcagcagctcttctcaatccctctgaccaaaacaggtaatttggcccagacaagagctaggataacagtggcctcaagttctttgcctccacatttcagtgctgggaaagccaaggtggacactctggaggtgatacggcatccggaagaaaccaccaacatgaagaggcaaactgtggcttcttacttccggtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtattattacttggcattcacagcacatcaaacacctcttgctagcaaagagagctgtgtggctatcttggaaaagtccagattagatcactgggtactgggaaaaacaaaggtttttctcaaatattaccatgttgagcaattaaatttgctgcttcgagaagtcataggcagagtggttgtgctgcaggcatataccaaggggtggcttggagccaggagatacaaaagggtcagagagaagagagagaagggagccattgccatccagtcaggggacacttcaaaccaaagcagtgggccacattcccccgtcgcagcaggtacgaggggaagtgccgaggttcaagactgcagcgagcctggtgaccataaagttctcaggggctctgtacatcgtaggagccattcacaagcagaatccaacaatggccgtacacagacttcaagcaactctcctgctgtcacagagaaaaatgggcattcacaagcccagagttctccaaaagggtgcgatatcttcgcaggacatgcaaacaagcactcggtttctgggactgatttgctgtcttctcggatatgccatcctgctccagatcagcaaggattgagtctctggggagcccctcaaaagcctgcctttccacattacggatgtaacttttatgggttcagaaaatggtcttgcacagaagcatcgaacacctcgccgacgatgtcagcagcccaaaatgctgagtag

SEQ ID NO: 6957 - DNA, 3548 bp, synthetic construct
  misc_feature 1..3548: note = Synthetic polypeptide
  source 1..3548: mol_type = other DNA
gtatatggtagacacacccgacagcaataatttaacttgagcataccctgaggatgatcctgtatggcagttgcacctgaatatgtgtttggagttcagagcgtgcccaacccagagataaattccttgtctgtgaggaacatctgagctctgggcccttcctgtggaacatcagcatacaggggagtgaggctctttgttttgcgttaaatgaaggttgccaggtggaggttgttaggaggagggagtgaagtgaaaatgctatataaactgcatgctttttgcatgcagtggtggttcttctgtccagcacatggctactgcatcatccctgtatgtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggatacaattatccatcagttgcagaaacgttatgcagacttgctaatttacacatatgttggagacatcttaattgccttaaaccccttccagaatctaagcatatactctccacagttttccagactttatcatggggtgaaacgcgcctccaatcccccccacatatttgcatcagcagatgctgcttaccagtgcatggttactctcagcaaagaccagtgcattgtcatcagcggagagagtggctctgggaagacagaaagcgcccacctgattgttcagcatttgactttcttgggaaaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgagagagaaaaattttcatatattttactatatttatgctggtcttcatcaccaaaagaagctttctgatttcagacttcctgaggaaaaacctcctaggtacatagctgatgaaactggaagggtgatgcacgacataacttccaaggagtcttacagaagacaattcgaagcaattcagcattgcttcaggattatagggttcacggacaaagaggtgcactcagtgtacagaattttggctgggattttgaatattgggaacattgagttcgcagctatttcctctcaacatcagactgataaaagtgaggtgcccaatgctgaagctttgcaaaatgctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatgtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcagatggaatatcagaatgaaggcattgatgctgtacccgtggaatatgaggacaaccgcccgctcttggacatgttcctccagaaacccctgggactgcttgcacttttggatgaggaaagtcggtttccccaagcaactgaccagaccctggttgataaatttgaagataatctacgatgcaaatacttctggaggcccaaaggagtggaactgtgctttggcattcagcattatgctggaaaggtattatatgatgcttctggggttcttgagaaaaatagagacactctccctgccgatgtggttgtggtcctgagaacgtcagaaaacaagcttcttcagcagctcttctcaatccctctgaccaaaacaggtaatttggcccagacaagagctaggataacagtggcctcaagttctttgcctccacatttcagtgctgggaaagccaaggtggacactctggaggtgatacggcatccggaagaaaccaccaacatgaagaggcaaactgtggcttcttacttccggtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtattattacttggcattcacagcacatcaaacacctcttgctagcaaagagagctgtgtggctatcttggaaaagtccagattagatcactgggtactgggaaaaacaaaggtttttctcaaatattaccatgttgagcaattaaatttgctgcttcgagaagtcataggcagagtggttgtgctgcaggcatataccaaggggtggcttggagccaggagatacaaaagggtcagagagaagagagagaagggagccattgccatccagtcagcctggagaggatatgatgctcggaggaaatttaagaaaataagcaacagaaggaatgagtctgctgctcataatcaagcaggggacacttcaaaccaaagcagtgggccacattcccccgtcgcagcaggtacgaggggaagtgccgaggttcaagactgcagcgagcctggtgaccataaagttctcaggggctctgtacatcgtaggagccattcacaagcagaatccaacaatggccgtacacagacttcaagcaactctcctgctgtcacagagaaaaatgggcattcacaagcccagagttctccaaaagggtgcgatatcttcgcaggacatgcaaacaagcactcggtttctgggactgatttgctgtcttctcggatatgccatcctgctccagatcagcaaggattgagtctctggggagcccctcaaaagcctggttcagaaaatggtcttgcacagaagcatcgaacacctcgccgacgatgtcagcagcccaaaatgctgagtagccctgaggacaccatgtactataaccagttaaatggaactctagaatatcaagggagcaagaggaagccaagaaaacttggccaaatcaaagtacttgatggggaagatgaatattacaaatctctgtcaccagtggactgtatccctgaggagaacaactcagcccacccttcctttttttcttcatcctcaaaaggagactcttttgctcaacattaa

SEQ ID NO: 6958 - DNA, 3467 bp, synthetic construct
  misc_feature 1..3467: note = Synthetic polypeptide
  source 1..3467: mol_type = other DNA
gtatatggtagacacacccgacagcaataatttaacttgagcataccctgaggatgatcctgtatggcagttgcacctgaatatgtgtttggagttcagagcgtgcccaacccagagataaattccttgtctgtgaggaacatctgagctctgggcccttcctgtggaacatcagcatacaggggagtgaggctctttgttttgcgttaaatgaaggttgccaggtggaggttgttaggaggagggagtgaagtgaaaatgctatataaactgcatgctttttgcatgcagtggtggttcttctgtccagcacatggctactgcatcatccctgtatgtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggatacaattatccatcagttgcagaaacgttatgcagacttgctaatttacacatatgttggagacatcttaattgccttaaaccccttccagaatctaagcatatactctccacagttttccagactttatcatggggtgaaacgcgcctccaatcccccccacatatttgcatcagcagatgctgcttaccagtgcatggttactctcagcaaagaccagtgcattgtcatcagcggagagagtggctctgggaagacagaaagcgcccacctgattgttcagcatttgactttcttgggaaaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgagagagaaaaattttcatatattttactatatttatgctggtcttcatcaccaaaagaagctttctgatttcagacttcctgaggaaaaacctcctaggtacatagctgatgaaactggaagggtgatgcacgacataacttccaaggagtcttacagaagacaattcgaagcaattcagcattgcttcaggattatagggttcacggacaaagaggtgcactcagtgtacagaattttggctgggattttgaatattgggaacattgagttcgcagctatttcctctcaacatcagactgataaaagtgaggtgcccaatgctgaagctttgcaaaatgctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatgtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcagatggaatatcagaatgaaggcattgatgctgtacccgtggaatatgaggacaaccgcccgctcttggacatgttcctccagaaacccctgggactgcttgcacttttggatgaggaaagtcggtttccccaagcaactgaccagaccctggttgataaatttgaagataatctacgatgcaaatacttctggaggcccaaaggagtggaactgtgctttggcattcagcattatgctggaaaggtattatatgatgcttctggggttcttgagaaaaatagagacactctccctgccgatgtggttgtggtcctgagaacgtcagaaaacaagcttcttcagcagctcttctcaatccctctgaccaaaacaggtaatttggcccagacaagagctaggataacagtggcctcaagttctttgcctccacatttcagtgctgggaaagccaaggtggacactctggaggtgatacggcatccggaagaaaccaccaacatgaagaggcaaactgtggcttcttacttccggtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtattattacttggcattcacagcacatcaaacacctcttgctagcaaagagagctgtgtggctatcttggaaaagtccagattagatcactgggtactgggaaaaacaaaggtttttctcaaatattaccatgttgagcaattaaatttgctgcttcgagaagtcataggcagagtggttgtgctgcaggcatataccaaggggtggcttggagccaggagatacaaaagggtcagagagaagagagagaagggagccattgccatccagtcaggggacacttcaaaccaaagcagtgggccacattcccccgtcgcagcaggtacgaggggaagtgccgaggttcaagactgcagcgagcctggtgaccataaagttctcaggggctctgtacatcgtaggagccattcacaagcagaatccaacaatggccgtacacagacttcaagcaactctcctgctgtcacagagaaaaatgggcattcacaagcccagagttctccaaaagggtgcgatatcttcgcaggacatgcaaacaagcactcggtttctgggactgatttgctgtcttctcggatatgccatcctgctccagatcagcaaggattgagtctctggggagcccctcaaaagcctggttcagaaaatggtcttgcacagaagcatcgaacacctcgccgacgatgtcagcagcccaaaatgctgagtagccctgaggacaccatgtactataaccagttaaatggaactctagaatatcaagggagcaagaggaagccaagaaaacttggccaaatcaaagtacttgatggggaagatgaatattacaaatctctgtcaccagtggactgtatccctgaggagaacaactcagcccacccttcctttttttcttcatcctcaaaaggagactcttttgctcaacattaa

SEQ ID NO: 6959 - DNA, 2811 bp, synthetic construct
  misc_feature 1..2811: note = Synthetic polypeptide
  source 1..2811: mol_type = other DNA
gtatatggtagacacacccgacagcaataatttaacttgagcataccctgaggatgatcctgtatggcagttgcacctgaatatgtgtttggagttcagagcgtgcccaacccagagataaattccttgtctgtgaggaacatctgagctctgggcccttcctgtggaacatcagcatacaggggagtgaggctctttgttttgcgttaaatgaaggttgccaggtggaggttgttaggaggagggagtgaagtgaaaatgctatataaactgcatgctttttgcatgcagtggtggttcttctgtccagcacatggctactgcatcatccctgtatgtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggatacaattatccatcagttgcagaaacgttatgcagacttgctaatttacacatatgttggagacatcttaattgccttaaaccccttccagaatctaagcatatactctccacagttttccagactttatcatggggtgaaacgcgcctccaatcccccccacatatttgcatcagcagatgctgcttaccagtgcatggttactctcagcaaagaccagtgcattgtcatcagcggagagagtggctctgggaagacagaaagcgcccacctgattgttcagcatttgactttcttgggaaaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgagagagaaaaattttcatatattttactatatttatgctggtcttcatcaccaaaagaagctttctgatttcagacttcctgaggaaaaacctcctaggtacatagctgatgaaactggaagggtgatgcacgacataacttccaaggagtcttacagaagacaattcgaagcaattcagcattgcttcaggattatagggttcacggacaaagaggtgcactcagtgtacagaattttggctgggattttgaatattgggaacattgagttcgcagctatttcctctcaacatcagactgataaaagtgaggtgcccaatgctgaagctttgcaaaatgctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatgtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcagatggaatatcagaatgaaggcattgatgctgtacccgtggaatatgaggacaaccgcccgctcttggacatgttcctccagaaacccctgggactgcttgcacttttggatgaggaaagtcggtttccccaagcaactgaccagaccctggttgataaatttgaagataatctacgatgcaaatacttctggaggcccaaaggagtggaactgtgctttggcattcagcattatgctggaaaggtattatatgatgcttctggggttcttgagaaaaatagagacactctccctgccgatgtggttgtggtcctgagaacgtcagaaaacaagcttcttcagcagctcttctcaatccctctgaccaaaacaggtaatttggcccagacaagagctaggataacagtggcctcaagttctttgcctccacatttcagtgctgggaaagccaaggtggacactctggaggtgatacggcatccggaagaaaccaccaacatgaagaggcaaactgtggcttcttacttccggtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtattattacttggcattcacagcacatcaaacacctcttgctagcaaagagagctgtgtggctatcttggaaaagtccagattagatcactgggtactgggaaaaacaaaggtttttctcaaatattaccatgttgagcaattaaatttgctgcttcgagaagtcataggcagagtggttgtgctgcaggcatataccaaggggtggcttggagccaggagatacaaaagggtcagagagaagagagagaagggagccattgccatccagtcag

SEQ ID NO: 6960 - DNA, 605 bp, synthetic construct
  misc_feature 1..605: note = Synthetic polypeptide
  source 1..605: mol_type = other DNA
gtatatggtagacacacccgacagcaataatttaacttgagcataccctgaggatgatcctgtatggcagttgcacctgaatatgtgtttggagttcagagcgtgcccaacccagagataaattccttgtctgtgaggaacatctgagctctgggcccttcctgtggaacatcagcatacaggggagtgaggctctttgttttgcgttaaatgaaggttgccaggtggaggttgttaggaggagggagtgaagtgaaaatgctatataaactgcatgctttttgcatgcagtggtggttcttctgtccagcacatggctactgcatcatccctgtatgtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggtactaaatatttag

SEQ ID NO: 6961 - DNA, 316 bp, synthetic construct
  misc_feature 1..316: note = Synthetic polypeptide
  source 1..316: mol_type = other DNA
acttccaacatgacaatgtgagaagctccactgatatgctcccttgtcaaactggtgaaaattatttttggaactacagacatttaatagcttctagaaatggtactaaggacaaaaagcaaatgaagagacatctattcaagaaaatctacaaaaatttgcctctgcctgtgagtttctggatattgtagagctgctgctccagtctggtgctgaccccactctccgagaccaggatggctgcctgccagaggaggtgacaggctgcaaaacagtttctttggtgctgcagcggcacacaactggcaaggcttaa

SEQ ID NO: 6962 - DNA, 459 bp, synthetic construct
  misc_feature 1..459: note = Synthetic polypeptide
  source 1..459: mol_type = other DNA
ccgggcgatgtagctcacccttgtaatcccagcactttgggaggccgaagcagttggatcatttgaggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagacccttctttaacagttagagctgacatagctggaagatactctaacagattgtacacatatgagcctcgggatttacccctattgatagaaaacatgaagaaagcattaagacttattcagtcagagctataa

SEQ ID NO: 6963 - DNA, 450 bp, synthetic construct
  misc_feature 1..450: note = Synthetic polypeptide
  source 1..450: mol_type = other DNA
ccgggcgatgtagctcacccttgtaatcccagcactttgggaggccgaagcagttggatcatttgaggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagacccttctttaacagttagagctgacatagctggaagatactctaacagattgtacacatatgagcctcgggatttacccctatgtaagtattcacaaatgatctcaaacagtggtcatagctga

SEQ ID NO: 6964 - DNA, 409 bp, synthetic construct
  misc_feature 1..409: note = Synthetic polypeptide
  source 1..409: mol_type = other DNA
ccgggcgatgtagctcacccttgtaatcccagcactttgggaggccgaagcagttggatcatttgaggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagacccttctttaacagttagagctgacatagctggaagatactctaacagattgtacacatatgagcctcgggatttacccctat

SEQ ID NO: 6965 - DNA, 763 bp, synthetic construct; identical to SEQ ID NO: 606
  misc_feature 1..763: note = Synthetic polypeptide
  source 1..763: mol_type = other DNA

SEQ ID NO: 6966 - DNA, 952 bp, synthetic construct
  misc_feature 1..952: note = Synthetic polypeptide
  source 1..952: mol_type = other DNA
ccgggcgcggcggctcacgcctgtaattccagcactttgggaggccgagacgggcggatcacgagatctccattacaagctcataatgaatcagacatcacagaagaaagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcgtgggcgtcttgcgggcggtagcgccgacactgtgcgctctcctgcagacagcctctccatgtcaagcttccagtctgtcaagtccatctctaattcaggcaaggccaggccccagcccggctccttcaacaagcaagattcaaaagctgacgtctcccagaaggcggacctggaagaggagcccctacttcacaacagcaagctggacaaagttcctggggtacaagggcaggccagaaaggagaaagcagaggcctctaatgcaggagctgcctgtatggggaacagccagcaccagggcaggcagatgggggcgggggcacaccccccaatgatcctgccccttcccctgcgaaagcccaccacacttaggcagtgcgaagtgctcatccgcgagctgtggaataccaacctcctgcagacccaagagctgcggcacctcaagtccctcctggaagggagccagaggccccaggcagccccggaggaagctagctttcccagggaccaagaagccacgcatttccccaaggtctccaccaagagcctctccaagaaatgcctgagcccacctgtggcggagcgtgccatcctgcccgcactgaagcagaccccgaagaacaactttgccgagaggcagaagaggctgcaggcaatgcagaaacggcgcctgcatcgctcagtgctttga

SEQ ID NO: 6967 - DNA, 754 bp, synthetic construct
  misc_feature 1..754: note = Synthetic polypeptide
  source 1..754: mol_type = other DNA
ccgggcgcggcggctcacgcctgtaattccagcactttgggaggccgagacgggcggatcacgagatctccattacaagctcataatgaatcagacatcacagaagaaagacagcctctccatgtcaagcttccagtctgtcaagtccatctctaattcaggcaaggccaggccccagcccggctccttcaacaagcaagattcaaaagctgacgtctcccagaaggcggacctggaagaggagcccctacttcacaacagcaagctggacaaagttcctggggtacaagggcaggccagaaaggagaaagcagaggcctctaatgcaggagctgcctgtatggggaacagccagcaccagggcaggcagatgggggcgggggcacaccccccaatgatcctgccccttcccctgcgaaagcccaccacacttaggcagtgcgaagtgctcatccgcgagctgtggaataccaacctcctgcagacccaagagctgcggcacctcaagtccctcctggaagggagccagaggccccaggcagccccggaggaagctagctttcccagggaccaagaagccacgcatttccccaaggtctccaccaagagcctctccaagaaatgcctgagcccacctgtggcggagcgtgccatcctgcccgcactgaagcagaccccgaagaacaactttgccgagaggcagaagaggctgcaggcaatgcagaaacggcgcctgcatcgctcagtgctttga

SEQ ID NO: 6968 - DNA, 450 bp, synthetic construct
  misc_feature 1..450: note = Synthetic polypeptide
  source 1..450: mol_type = other DNA
ccgggcgcggcggctcacgcctgtaattccagcactttgggaggccgagacgggcggatcacgagatctccattacaagctcataatgaatcagacatcacagaagaaagacagcctctccatgtcaagcttccagtctgtcaagtccatctctaattcaggcaaggccaggccccagcccggctccttcaacaagcaagattcaaaagctgacgtctcccagaaggcggacctggaagaggagcccctacttcacaacagcaagctggacaaagttcctggggtacaagggcaggccagcccaccacacttaggcagtgcgaagtgctcatccgcgagctgtggaataccaacctcctgcagacccaagagctgcggcacctcaagtccctcctggaagggagccagaggccccaggcagccccggaggaagctagctttcccaggtga

SEQ ID NO: 6969 - DNA, 1192 bp, synthetic construct
  misc_feature 1..1192: note = Synthetic polypeptide
  source 1..1192: mol_type = other DNA
actctctctgagcatggccagtttctatgtcatgaggcagtctagaggaggggaaaaccagctaccatgttgtgagggaactcagacaccttctggagaggcttgtatgctgaagaactaaggcctgcctgcagcaatgtgagtgcgcttgcaagcagatcttctgaagccagcccacagccacatcagtgagcttgggagcacattctcctgcccaatcaagctttccgatgtctgcagccctggctgacagcttgactccaacatcatgaaagaccctgagccagaggcatccagccaagccactccaaaattcctggcctgcagaaactatgtcatccatactgtagggccaatagccaggggccatattaatggttcccacaaggaagaccttgcaaattgctataaatcatctctgaagctcgtgaaagaaaataacatccgatcagttgcatttccctgcatctcaacaggcatttatggctttcccaacgagcctgctgcagtcattgccctcaacaccattaaggaatggcttgccaagaatcaccatgaggtggatcggatcattttctgtgtcttcttagaagttgacttcaaaatctacaaaaagaaaatgaatgagtttttctccgtagacgataataatgaagaagaagaggatgttgaaatgaaagaagattcagatgagaacggtccagaggagaagcaaagtgtggaagaaatggaagagcagagccaagatgcagatggtgtcaacactgtcactgtgcccggccctgcttcagaagaggcagttgaagactgtaaagatgaagattttgcaaaggatgaaaatattacaaaaggcggtgaagtgacagatcattctgtgcgtgaccaagatcatcccgatggacaagagaatgattcaacgaagaatgaaataaaaattgaaacagaatcgcagagctcatatatggaaacagaagaactttcatcaaaccaagaagatgccgtgattgtggagcaaccagaagtgattccattaacagaggaccaagaagaaaaagaaggtgaaaaagctccaggcgaggacacacctaggatgcctgggaaaagtgaaggctccagtgacctagaaaatactccaggtcctgatgcaggggcacaagatgaagcgaaggaacaaagaaatggaactaaatga

SEQ ID NO: 6970 - DNA, 1261 bp, synthetic construct
  misc_feature 1..1261: note = Synthetic polypeptide
  source 1..1261: mol_type = other DNA
actctctctgagcatggccagtttctatgtcatgaggcagtctagaggaggggaaaaccagctaccatgttgtgagggaactcagacaccttctggagaggcttgtatgctgaagaactaaggcctgcctgcagcaatgtgagtgcgcttgcaagcagatcttctgaagccagcccacagccacatcagtgagcttgggagcacattctcctgcccaatcaagctttccgatgtctgcagccctggctgacagcttgactccaacatcatgaaagaccctgagccagaggcatccagccaagccactccaaaattcctggcctgcagaaactatgtcatccatactgtagggccaatagccaggggccatattaatggttcccacaaggaagaccttgcaaattgctataaatcatctctgaagctcgtgaaagaaaataacatccgatcagttgcatttccctgcatctcaacaggcatttatggctttcccaacgagcctgctgcagtcattgccctcaacaccattaaggaatggcttgccaagaatcaccatgaggtggatcggatcattttctgtgtcttcttagaagttgacttcaaaatctacaaaaagaaaatgaatgagtttttctccgtagacgataataatgaagaagaagaggatgttgaaatgaaagaagattcagatgagaacggtccagaggagaagcaaagtgtggaagaaatggaagagcagagccaagatgcagatggtgtcaacactgtcactgtgcccggccctgcttcagaagaggcagttgaagactgtaaagatgaagattttgcaaaggatgaaaatattacaaaaggcggtgaagtgacagatcattctgtgcgtgaccaagatcatcccgatggacaagagaatgattcaacgaagaatgaaataaaaattgaaacagaatcgcagagctcatatatggaaacagaagaactttcatcaaaccaagaagatgccgtgattgtggagcaaccagaagtgattccattaacagaggaccaagaagaaaaagaaggtgaaaaagctccaggcgaggacacacctaggatgcctgggaaaagtgaaggctccagtgacctagaaaatactccaggtcctgatgttgaaatgaatagtcaggttgacaaggtaaatgacccaacagagagtcaacaagaagatcaactaatagcaggggcacaagatgaagcgaaggaacaaagaaatggaactaaatga

SEQ ID NO: 6971 - DNA, 191 bp, synthetic construct
  misc_feature 1..191: note = Synthetic polypeptide
  source 1..191: mol_type = other DNA
atgtaaagtgcccgcagtgcctggcacatggtgcctttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtga

SEQ ID NO: 6972 - DNA, 194 bp, synthetic construct
  misc_feature 1..194: note = Synthetic polypeptide
  source 1..194: mol_type = other DNA
atgtaaagtgcccgcagtgcctggcacatggtgcctttgagatagagataaatggacagctggtgttctccaagctggagaatgggggctttccctatgagaaagatgtgagtatttacagcgttgggaggacctcttggtcaccctaccccaacagtgcatcatcctgtcattccactcctctagctcattga

SEQ ID NO: 6973 - DNA, 1009 bp, synthetic construct
  misc_feature 1..1009: note = Synthetic polypeptide
  source 1..1009: mol_type = other DNA
gggacctttaagaggtgactaggccatgaaaactccaccctcataggtggaatttgtgctgttattgaaaggcaacttcagttccttcttgttctctcttgccctttggccttctgccatgggatgacacagcaagaaggccctcaccagatgccagctgtttggtcttctactttccagccttcagaactacagccttttgattgattatcaatttaccttcagcttattacaggaagatgatcgccaccatactgccataaactttatagcaaacccagaacagtcgaacaaaaatctggatatatcaattaatgcatcaaacaactttaatctcaacattacgtggtctgtcggttcaacagctggaacaatatctggggaagagacttctatagtttccaagaataatataaaggaatacagagatagtttttcctatgaaaaatttaactttagaagcaatcctaacattacattctatgtgtacgtcagcaacttttcctggcctattaaaatacagattgcattctcacaacacaatacaatcatggaccttgtgcagttttttgtcaccttcttcagttgtttcctatccttattgctggtggctgctgtggtatggaagatcaaacaaacttgttgggcttctcgacggagagagcaactgcttcgagaacgacagcagatggccagccgtccctttgcttctgttgatgtagctctggaagtgggagctgaacaaacagagtttctgcgagggccattagagggggcacccaagccaattgccattgaaccatgtgctgggaacagagctgctgttctgactgtgtttctttgtctaccacgaggatcatcaggtgcccctccccctgggcagtcaggccttgcaattgccagtgccctaatagatatttcacaacagaaagcttcagatagtaaagataagacttctggagtccggaatcgaaaacacctttcaacacgtcaaggaacttgtgtctga

SEQ ID NO: 6974 - DNA, 267 bp, synthetic construct
  misc_feature 1..267: note = Synthetic polypeptide
  source 1..267: mol_type = other DNA
gggacctttaagaggtgactaggccatgaaaactccaccctcataggtggaatttgtgctgttattgaaaggcaacttcagttccttcttgttctctcttgccctttggccttctgccatgggatgacacagcaagaaggccctcaccagatgccagctgtttggtcttctactttccagccttcagaactacagccttttgattgattatcaatttaccttcagcttattacaggaagatgatcgccaccatactgccataaactt

SEQ ID NO: 6975 - DNA, 864 bp, synthetic construct
  misc_feature 1..864: note = Synthetic polypeptide
  source 1..864: mol_type = other DNA
agtgaaaagaattgtgcagttggagttagacctatggtttgagactcagctttgggactgagcaaatcatttcacgtgatcaattttctaagctccagtttcctcattaggaaaaaagaagacaaagtaatacttgttgtaatggaattaaatgagataatgtcttcagaatgccattcttccgtgtgtgctaagatcgtgcagctcctggggcagaatgaggtggactatcgccagaagcaggtggtcatcctgagccaggatagcttctaccgtgtccttacctcggagcagaaggccaaagccctgaagggccagttcaactttgaccacccggatgcctttgacaatgaactcattctcaaaacactcaaagaaatcactgaagggaaaacagtccagatccccgtgtatgactttgtctcccattcccggaaggaggagacagttactgtctatcccgcagacgtggtgctctttgaagggatcctggccttctactcccaggaggtacgagacctgttccagatgaagctttttgtggatacagatgcggacacccggctctcacgcagagtattaagggacatcagcgagagaggcagggatcttgagcagattttatctcagtacattacgttcgtcaagcctgcctttgaggaattctgcttgccaacaaagaagtatgctgatgtgatcatccctagaggtgcagataatctggtggccatcaacctcatcgtgcagcacatccaggacatcctgaatggagggccctccaaacggcagaccaatggctgtctcaacggctacaccccttcacgcaagaggcaggcatcggagtccagcagcaggccgcattga

SEQ ID NO: 6976 - DNA, 471 bp, synthetic construct
  misc_feature 1..471: note = Synthetic polypeptide
  source 1..471: mol_type = other DNA
agtgaaaagaattgtgcagttggagttagacctatggtttgagactcagctttgggactgagcaaatcatttcacgtgatcaattttctaagctccagtttcctcattaggaaaaaagaagacaaagtaatacttgttgtaatggaattaaatgagataatgtcttcagaatgccattcttccgtgtgtgctaagatcgtgcagctcctggggcagaatgaggtggactatcgccagaagcaggtggtcatcctgagccaggatagcttctaccgtgtccttacctcggagcagaaggccaaagccctgaagggccagttcaactttgaccacccggatgcctttgacaatgaactcattctcaaaacactcaaagaaatcactgaagggaaaacagtccagatccccgtgtatgactttgtctcccattcccgtattaagggacatcagcgagagaggcagggatcttga

SEQ ID NO: 6977 - DNA, 1905 bp, synthetic construct
  misc_feature 1..1905: note = Synthetic polypeptide
  source 1..1905: mol_type = other DNA
ggccaggtgtggtggctcacgcctgtaatcccagcactttgggaggcaaaggtgggtggatcacgaggtcaggagatccagaccatcctggctaacatggtgaaaccccacctctactagtaatacaaaaaatcagccgggcgtggtggtgggtgcctgtagtcccagctactccggaggctgagacaaaagaatggcgtgaacccgcgaggcggagcttgtgagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagattcaactagcctatcaaaaatcttggatacagttcattcttgtgaaagagcaagggaacttcaaaaagatcactgtgaacaacgtacaggaaaaatggaacaaatgaaaaagaagttttgtgtactgaaaaagaaactgtcagaagcaaaagaaataaaatcacagttagagaaccaaaaagttaaatgggaacaagagctctgcagtgtgagattgactttaaaccaagaagaagagaagagaagaaatgccgatatattaaatgaaaaaattagggaagaattaggaagaatcgaagagcagcataggaaagagttagaagtgaaacaacaacttgaacaggctctcagaatacaagatatagaattgaagagtgtagaaagtaatttgaatcaggtttctcacactcatgaaaatgaaaattatctcttacatgaaaattgcatgttgaaaaaggaaattgccatgctaaaactggaaatagccacactgaaacaccaataccaggaaaaggaaaataaatactttgaggacattaagattttaaaagaaaagaatgctgaacttcagatgaccctaaaactgaaagaggaatcattaactaaaagggcatctcaatatagtgggcagcttaaagttctgatagctgagaacacaatgctcacttctaaattgaaggaaaaacaagacaaagaaatactagaggcagaaattgaatcacaccatcctagactggcttctgctgtacaagaccatgatcaaattgtgacatcaagaaaaagtcaagaacctgctttccacattgcaggagatgcttgtttgcaaagaaaaatgaatgttgatgtgagtagtacgatatataacaatgaggtgctccatcaaccactttctgaagctcaaaggaaatccaaaagcctaaaaattaatctcaattatgcaggagatgctctaagagaaaatacattggtttcagaacatgcacaaagagaccaacgtgaaacacagtgtcaaatgaaggaagctgaacacatgtatcaaaacgaacaagataatgtgaacaaacacactgaacagcaggagtctctagatcagaaattatttcaactacaaagcaaaaatatgtggcttcaacagcaattagttcatgcacataagaaagctgacaacaaaagcaagataacaattgatattcattttcttgagaggaaaatgcaacatcatctcctaaaagagaaaaatgaggagatatttaattacaataaccatttaaaaaaccgtatatatcaatatgaaaaagagaaagcagaaacagaaaactcatga

SEQ ID NO: 6978 - DNA, 189 bp, synthetic construct
  misc_feature 1..189: note = Synthetic polypeptide
  source 1..189: mol_type = other DNA
caggggtccccaacccccgtccatgccttgttaggaaccaggccccacagcatgcggtttgttttggagcagtacaacgctctgtcctggctcacgtgcaatccggccacccaggaccgtacttcctgccttcccgtccactttgtggtgctcactcagttgtacaatgccatcatgaatatactttaa

SEQ ID NO: 6979 - DNA, 1397 bp, synthetic construct; identical to SEQ ID NO: 657
  misc_feature 1..1397: note = Synthetic polypeptide
  source 1..1397: mol_type = other DNA

SEQ ID NO: 6980 - DNA, 120 bp, synthetic construct
  misc_feature 1..120: note = Synthetic polypeptide
  source 1..120: mol_type = other DNA
ggccagtttcgtgtggctgatcaaagaaagaaggcatacgcagatttctacagaaactacgatgtcatgaaagattttgaggagatgaggaaggctggtatctttcagagtgtaaagtaa

SEQ ID NO: 6981 - DNA, 4900 bp, synthetic construct
  misc_feature 1..4900: note = Synthetic polypeptide
  source 1..4900: mol_type = other DNA
tccattccaagatggctaaatagtaacagctctggtctgcagcttctcgtgtgatcgatgcagaagatgggtgatttctgcatttccagctgaggtacctggttcatctcattgggactggttggacagtggatgcagcccatggagggcaagccaaagaagggtggggcatcacctcacctgggaagtgcaaggggtctggggatttccttttcctagccaagggaagccgtgacaggctgtaccaggaaaattgggacactgccacctaaatactgcacttttccaaagatcttagcaaaaggcatatcaggagattatatcccacgcctggatccgtgggtcccatgcccatggagccttgctcactgctagcacagcagtccgagattgaagtgctaggtggcagcctggctgagggaggggcatccaccattgctgaggcttgagtaggtaaacaaagcagcagggaatctcgaactaggtggagcccaccgcagctcaatgaggcctgcctgcctctgtagactccacctctgtaggcatggcatcgctgaacaaaaggtagcagaaacttctgcagacttaaacatccctgtctgacagctctgaagagagcaatggttctcccagcatggtgtttgagctctgagaatgaacagactgcctcctcaagtgggtccctgaccccactgtagcctaactgggagacatctcccactaggggccaacacacacctcatacagctgggtgcccctctgagatgaagctttcagaggaaggatcaggcagcaatatttgctgttctgcaatatttgctgctctgcagcctctgctggtgatacccaggcaaacagtgttgggagtggacctccagcaaactccaacagaccagcagctgagggacctgactgttagaaggaaaactgacagacagaaaagaattgcatcaacatcaacaaaaaggacacccacaccaaaaccccatctgtaggtcaccatcatcaaaggccaaaggtagataaaaccacaaagatggggagaaaccagagcaggaaagctaaaaattctaaaaaccagggcacctcttctcctccaaaggatcacagctcctcactagtaatggaacaaagctggacagagaatgactttgatgagttggcagaagtaggtttcagaaggtcagtaataacaaacttctctgagctaaaggaggatgttcaaacccatcacaaggaagcaaaaagccttgaaaagagattagatgaatggctaactagaataaacagtgtagagcagactttaaatcacccaatggagctgaaaaccatggcacgagaactatgtgatacatgcacaagcttcagtagacaattcgatcaagtggaggaaagggtatcagtgattgaagatcaaattattgaaatgaagtaagaagagaagtttagagaaaaaggagtaaaaagaaatgaacaaagcctccaagaaatatgggactatgtgaaaagatcaaatctacatcagattggtgtactcgaaagtgaccgagagaatggagccaagttggaaaacactcttcaggatattatgtaggagaacttccccaacctagcaaggtaggccaacatccaaattcaggaaatacagagaccaacaaaaagatactccacgacaagagcacccccaagacacataattgtcagattcaccaaggttgaaatgagggaaaaaatgttaagacagccagagagaacggtcgggttaccaataaagggaagcccatcagactaacagctgatctctcggcacaaactctacaagccaggaaagagtgggggtcaatattcaacattcttaaaaaaaagaattttcaacccagaatttcatatccagccaaactaagcttcataagagaaggagaaataaaatactttacagacaagcaaatgctgagagattttgtcaccaccaggactgccttacaagagctcctgaaggaagcactaaagatggaaaggaacaaccagtaccagccactgcaaaaacatgccagattgtaaagaccatcaatgctaggaagaaactgcatcaactaatgagcaaaataaccagctaacatcataatgacaggatcaaattcatgcataacaatattaaccttaaatgtaaatgggctaaatgctccaattaaaagacacagactggcaaattggataaagagtcaagacccatcagtgtgctgtattgaggagacccatctcatgtgcagcaacacacaaaggctcaaaataaagggatggaggaagttctgccaagcaaatggaaagcaaaaaaaaggcaggggttgcaatcctagtctctgaaaaaacagacttcaaaccaacaaagatcaaaagatacaaagaagaccattacaacaatggtaaagggatcaattcaacaagaagagctaactattctaaacatatatgcacccaatacaggagcacccagattcataaagcaagtccttagagacctacaaagagacttagactcccacacaataatgggagactttaacaccccactgtcaatattagatgtatcaatgagacagaaggttaacaaggatatccaggacttaaactcagctctgcaccacgcagacctaatagacatctacagaactctccaccccaaatcaatagaatatacattcttctcaggaccacatcatatttattccaaaattgaccacatagttggaagtgaagcaccccttagcaaatgtaaaagaacagaaattaccacaaattgtctctcagaccacagtgcaatcaaattagagctcaggattaagaaactcactcaaaactgcacaactacatggaaattgaacaacctgttcctgaatgactactgggtacataacgaaatgaaggcagaaataaagatgttctttgaaaccagtgagaacaaagacacaacataccagaatctctgggacacatttaaaggagggtgtagagggaaatttatagcactaaatgcccacaagagaaaccaggaaagatctaaaatcaatctcctaacatcacaattaaaagaactagagaagcaagagcaaacacattcaaaagctagcagaaggcaagaaataactaagatcagagcagaactgaaggagatagagacacaaaaaccccttcaaaaaatcaaggaatccaggagctggttttttgaaaagatcaacaaaattgatagaccactagcaagactaataaagaagaaaagagagaagaatcaaatagacgcaataaaaaatgataaaggggatatcaccgctgatcccacagaaatacaaactaccgtcagagaatactatacacatctctatgcaaataaattacaaaacctagaagacatggataaattcctggagacatacaccctcccacgactaaaccagaaagaagttgaatcactgaatagacccataacaggttctgaaattgaggcaataattactggcctaccaaccaaaaagagtccacaaccagacagattcacagccgaattctaccagaggtacaaagaggagctggtactgttccttctgaaactattccaatcaatacaaaaaagagggaatcctccctaactgattttatgaggccagcatcatcctgataccaaagcctggcagagacacaataaaaaaagagaattttagaccaacatccctgatgaacatcgatgcgaaaatcctcaataatatactggcaaaccgaatccagcagcacatcaaaaagcttatccaccaagatgaagttggcttcattcctggaatgcaaggctggttgaacatatgcaaatcaataaacttaatccatcacataaacagaaccaatgacaaaaaccacatgattatctcaatagatgcagaaaaggccttcaacaaaattcaagaactcttcatgctaaaaactctcaataaattaggtattgatggaacatatctcaaaataataagagctatttatgacaaacccacagccaatatcatactgaatgggcaaaactggaagcattccctttgaaaactggcacaagacaggggtgccctctctcaccacccctattcaacatagtgttggaagttctggccaggaccatcaggcaagagaaaaaaagaaagtgtattcagttaggaaaagatgaagtcaaattgtccctgtttgcagttgacatgattttatatttagaaaacaccatcatctcagcccaaaatttccttaagctgataagtaacttcagcaaagtctcaggatacaaaatcaatgtgcaaaaatcacaagcattcttatacaccaataacagacaaacagagaggcaaatcatgaatgaactcccattcacaattgctacaaagagaataaaatacctaggaatccaacttacaagggatgtgaaggacctcttcaaggagaactacaaaccactgctcaatgaaataaaagaggacacaaacaaatggaagagcattccatgctcatggataggaaaaatcaatatcgtgaaaatggccatactgcccaaggaataactgtgtttatcaatatttgggctcttcaccacaacccctatttctgggaagaccctcaggtctttaaccccttgagattctccagggaaaattctgaaaaaatacatccctatgccttcataccattctcagctggattaaggaactgcattgggcagcattttgccataattgagtgtaaagtggcagtggcattaactctgctccgcttcaagctggctccagaccactcaaggcctccccagcctgttcgtcaagttgtcctcaagtccaagaatggaatccatgtgtttgcaaaaaaagtttgctaa

SEQ ID NO: 6982 - DNA, 1313 bp, synthetic construct
  misc_feature 1..1313: note = Synthetic polypeptide
  source 1..1313: mol_type = other DNA
tgtgagctcattgagagctgggtccaggactggcggtcggcctggacccccagggctacgggaaccccgacttctgctggctgtcgcttcaagacaccctgatttggagctttgcggggcccatcggagctgttataatcatcaacacagtcacttctgtcctatctgcaaaggtttcctgccaaagaaagcaccattattatgggaaaaaagggatcgtctccctgctgaggaccgcattcctcctgctgctgctcatcagcgccacctggctgctggggctgctggctgtgaaccgcgatgcactgagctttcactacctcttcgccatcttcagcggcttacagggccccttcgtcctccttttccactgcgtgctcaaccaggaggtccggaagcacctgaagggcgtgctcggcgggaggaagctgcacctggaggactccgccaccaccagggccaccctgctgacgcgctccctcaactgcaacaccaccttcggtgacgggcctgacatgctgcgcacagacttgggcgagtccaccgcctcgctggacagcatcgtcagggatgaagggatccagaagctcggcgtgtcctctgggctggtgaggggcagccacggagagccagacgcgtccctcatgcccaggagctgcaaggatccccctggccacgattccgactcagatagcgagctgtccctggatgagcagagcagctcttacgcctcctcacactcgtcagacagcgaggacgatggggtgggagctgaggaaaaatgggacccggccaggggcgccgtccacagcacccccaaaggggacgctgtggccaaccacgttccggccggctggcccgaccagagcctggctgagagtgacagtgaggaccccagcggcaagccccgcctgaaggtggagaccaaggtcagcgtggagctgcaccgcgaggagcagggcagtcaccgtggagagtaccccccggaccaggagagcgggggcgcagccaggcttgctagcagccagcccccagagcagaggaaaggcatcttgaaaaataaagtcacctacccgccgccgctgacgctgacggagcagacgctgaagggccggctccgggagaagctggccgactgtgagcagagccccacatcctcgcgcacgtcttccctgggctctggcggccccgactgcgccatcacagtcaagagccctgggagggagccggggcgtgaccacctcaacggggtggccatgaatgtgcgcactgggagcgcccaggccgatggctccgactctgagaaaccgtga

SEQ ID NO: 6983 - DNA, 827 bp, synthetic construct
  misc_feature 1..827: note = Synthetic polypeptide
  source 1..827: mol_type = other DNA
tagtgggatgattgactgggtgtcctggcccctggggaagaatattgacaagtggatcattgcactgctgaagggcctggctgctgttaagaagttcagcatcttgatcgaggtttcgctcaccaaaattgagaaggttttctctaagctgctgtaccccatcgtccggggagctgccttgtctgtgctcaagtacatgctcctgaccttccagcactcccacgaagccttccacctgctcctccctcacatcccccccatggtggcctctctggtcaaggaggactcgaactcggggaccagctgcctggagcagctggcggagctggtccactgcatggtgttccggttcccgggcttcccggatctgtatgagcctgtcatggaggccatcaaggacctccatgttcccaatgaggaccgcatcaagcagctgctggggcaggatgcctggacttcgcagaagagcgagctggcgggtttctatccccggctcatggccaagtcagacacgggcaagattggtctcatcaacctgggcaacacatgctatgtcaacagcatccttcaggccttattcatggcgtctgacttcagacattgtgtgctccgcttgactgagaacaactcacagcccctgatgaccaagctgcagtggctctttggcttcctagaacacagccagcggcctgccatttccccagagaacttcctctccgcatcctggacgccctggttcagccctggcacccagcaggactgctcggagtatctgaagtacctgctggatcggctgcacgaagaggagaaaacgggcacaaggatct

SEQ ID NO: 6984 - DNA, 2257 bp, synthetic construct
  misc_feature 1..2257: note = Synthetic polypeptide
  source 1..2257: mol_type = other DNA
tagtgggatgattgactgggtgtcctggcccctggggaagaatattgacaagtggatcattgcactgctgaagggcctggctgctgttaagaagttcagcatcttgatcgaggtttcgctcaccaaaattgagaaggttttctctaagctgctgtaccccatcgtccggggagctgccttgtctgtgctcaagtacatgctcctgaccttccagcactcccacgaagccttccacctgctcctccctcacatcccccccatggtggcctctctggtcaaggaggactcgaactcggggaccagctgcctggagcagctggcggagctggtccactgcatggtgttccggttcccgggcttcccggatctgtatgagcctgtcatggaggccatcaaggacctccatgttcccaatgaggaccgcatcaagcagctgctggggcaggatgcctggacttcgcagaagagcgagctggcgggtttctatccccggctcatggccaagtcagacacgggcaagattggtctcatcaacctgggcaacacatgctatgtcaacagcatccttcaggccttattcatggcgtctgacttcagacattgtgtgctccgcttgactgagaacaactcacagcccctgatgaccaagctgcagtggctctttggcttcctagaacacagccagcggcctgccatttccccagagaacttcctctccgcatcctggacgccctggttcagccctggcacccagcaggactgctcggagtatctgaagtacctgctggatcggctgcacgaagaggagaaaacgggcacaaggatctgccagaaactcaagcagtccagctcgccctctccgcccgaggagcccccggccccaagttcaacctctgtggaaaaaatgtttggaggcaagatagtgactcggatctgctgtctctgctgcctcaacgtctcctcccgggaggaggccttcacggacctctctctcgccttccctcctcctgagcgctgtcgccgccgccgcctgggctctgtgatgcgccccacagaagacatcacagcccgggagttgcccccaccaaccagtgcacaggggccaggcagggtgggtcctcggaggcaaaggaaacactgcatcacagaggacaccccccccaccagcctgtacatcgaaggcctggactccaaggaagctggtgggcagagcagtcaggaggaaaggatagagagggaggaagaagggaaggaggagagaacggagaaggaagaagtgggggaggaggaggaaagcaccagaggggaaggagagagggagaaagaggaggaggtggaagaggaagaagagaaggtggagaaggagacagaaaaggaggctgagcaggaaaaggaagaagacagcctgggagcggggacccacccggatgctgccatcccctccggggagcggacatgtggctctgagggctcccgctccgtcctggacctggttaactacttcctgtcccccgagaagctgacagcagaaaaccgctactactgcgagtcgtgtgcctccctgcaggatgccgagaaggtggtggagctgagccaagggccgtgctacctcatcctcacactgctgcgcttctctttcgacctgcgcaccatgcggcgccgcaagatcctggatgacgtctccatccccctgctgctccgcctgccactggctggtggccgtggccaggcctatgacctctgcagtgtggtggtgcactctggagtgtcttcggagagtggtcactactactgctatgcccgtgagggcgctgcccgccctgccgcttctctgggaactgccgataggccagagcccgagaaccagtggtacctgttcaatgacactcgggtgtccttctcttccttcgaatctgtcagcaacgtcacctccttcttccctaaggacacagcctatgtgctgttttaccggcagcggcccagggaggggcccgaggctgagttgggctcttctagagtccggacagagcccaccctgcacaaggacttgatggaagccatttccaaagacaacatcctttacctacaggagcaggagaaggaggcccggagcagggcggcctacatctctgcactccccacatctccgcactgggggaggggctttgatgaagacaaggatgaggatgaaggctctccagggggctgcaatcctgcaggtggcaatggtggtgacttccacagactggtcttctaa

SEQ ID NO: 6985 - DNA, 3119 bp, synthetic construct
  misc_feature 1..3119: note = Synthetic polypeptide
  source 1..3119: mol_type = other DNA
gttcatggatcagttttaagagatcaataaatccctcaccctgcaaattaggccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaa

SEQ ID NO: 6986 - DNA, 3110 bp, synthetic construct
  misc_feature 1..3110: note = Synthetic polypeptide
  source 1..3110: mol_type = other DNA
gttcatggatcagttttaagagatcaataaatccctcaccctgcaaattaggccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggaggttggcatggatcctattagctgtgtaatactggaattatcaatgatatgcactggtggaggtgttatttgtgctttagaagatacttgctgttga

SEQ ID NO: 6987 - DNA, 3053 bp, synthetic construct
  misc_feature 1..3053: note = Synthetic polypeptide
  source 1..3053: mol_type = other DNA
gttcatggatcagttttaagagatcaataaatccctcaccctgcaaattaggccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatggtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaa

SEQ ID NO: 6988 - DNA, 818 bp, synthetic construct
  misc_feature 1..818: note = Synthetic polypeptide
  source 1..818: mol_type = other DNA
ctcggctcccccttcaagagtaaacacatttttggctgcaagaagtgcagttaaccgacaggctctagctgcagcaccttcgggatctacgctgttcccggcagccccagcccatggctgtgcacagcaagagtcctggcaccaggacagtcttgcacagctagagtcccagtgcctggacatgcctgcccaccacaggccttctctaacgggcagtcggtgccagagctccctgctaagtcagctgagactgtgagacgcatcaaggcagccaaaggagactctggagatggtgtggatccgaggaagtggttgcggtccttcaggagtccatcagcctccccctggaaataccaccagatgaagaggttgagaacatcatctggtcctctcacaaaagtcttgccactgtggtgccagggaaagagggacatccagctaccatcatggtgaccaatccacactaccagggccaagtgagcttcctggaccccagctattccctgcatatcagcaatctgagctgggaggattcagggctttaccaagctcaagtcaacctgagaacatcccagatctctaccatgcagcagtacaatatatgtgtctaccatcctaactatgcttctgagaagccttcaacagccttctgcctcctggccaagggattgctcatcttcttgctcttggtaattctggccatgggactctgggtcatccgagtccagaaaagacacaaaatgccaaggatgaagaaactcatgagaaacagaatgaaattgaggaaggaggcaaagcctggctccagccctgcctga

SEQ ID NO: 6989 - DNA, 1091 bp, synthetic construct
  misc_feature 1..1091: note = Synthetic polypeptide
  source 1..1091: mol_type = other DNA
ctcggctcccccttcaagagtaaacacatttttggctgcaagaagtgcagttaaccgacaggctctagctgcagcaccttcgggatctacgctgttcccggcagccccagcccatggctgtgcacagcaagagtcctggcaccaggacagtcttgcacagctagagtcccagtgcctggacatgcctgcccaccacaggccttctctaacgggcagtcggtgccagagctccctgctaagtcagctgagactgtgagacgcatcaaggcagccaaaggagactctggagatggtgtggatccgaggaagtggttgcggtccttcaggagtccatcagcctccccctggaaataccaccagatgaagaggttgagaacatcatctggtcctctcacaaaagtcttgccactgtggtgccagggaaagagggacatccagctaccatcatggtgaccaatccacactaccagggccaagtgagcttcctggaccccagctattccctgcatatcagcaatctgagctgggaggattcagggctttaccaagctcaagtcaacctgagaacatcccagatctctaccatgcagcagtacaatatatgtgtctaccgatggctgtcagagccccagatcactgtgaactttgagagttctggggaaggtgcctgcagtatgtccctggtgtgctctgtggagaaggcaggcatggatatgacctacagctggctctcccggggggatagcacttatacattccatgaaggccctgtcctcagcacatcctggaggccgggggacagtgccctctcctacacctgcagagccaacaaccccatcagcaacgtcagttcttgccccatccctgatgggcccttctatgcagatcctaactatgcttctgagaagccttcaacagccttctgcctcctggccaagggattgctcatcttcttgctcttggtaattctggccatgggactctgggtcatccgagtccagaaaagacacaaaatgccaaggatgaagaaactcatgagaaacagaatgaaattgaggaaggaggcaaagcctggctccagccctgcctga

SEQ ID NO: 6990 - DNA, 859 bp, synthetic construct
  misc_feature 1..859: note = Synthetic polypeptide
  source 1..859: mol_type = other DNA
gaggccatgggttcttgcctccagctaacctgttaactggaggatcttgggcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctga

SEQ ID NO: 6991 - DNA, 657 bp, synthetic construct
  misc_feature 1..657: note = Synthetic polypeptide
  source 1..657: mol_type = other DNA
gaggccatgggttcttgcctccagctaacctgttaactggaggatcttgggcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcc

SEQ ID NO: 6992 - DNA, 587 bp, synthetic construct
  misc_feature 1..587: note = Synthetic polypeptide
  source 1..587: mol_type = other DNA
gaggccatgggttcttgcctccagctaacctgttaactggaggatcttgggcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcg

SEQ ID NO: 6993 - DNA, 568 bp, synthetic construct
  misc_feature 1..568: note = Synthetic polypeptide
  source 1..568: mol_type = other DNA
gaggccatgggttcttgcctccagctaacctgttaactggaggatcttgggcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagc

SEQ ID NO: 6994 - DNA, 494 bp, synthetic construct
  misc_feature 1..494: note = Synthetic polypeptide
  source 1..494: mol_type = other DNA
gaggccatgggttcttgcctccagctaacctgttaactggaggatcttgggcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcaggtgggcctctgtctgggagggtggcgtgggg

SEQ ID NO: 6995 - DNA, 368 bp, synthetic construct
  misc_feature 1..368: note = Synthetic polypeptide
  source 1..368: mol_type = other DNA
gaggccatgggttcttgcctccagctaacctgttaactggaggatcttgggcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttg

SEQ ID NO: 6996 - DNA, 661 bp, synthetic construct
  misc_feature 1..661: note = Synthetic polypeptide
  source 1..661: mol_type = other DNA
gcacctgtaatcccaactactccagaggctgagatctcgccttgcggatttttttaccaactgccagccagagtcaaggtctgtcagcagctgtctaaaggaaaactacgctgactgcctcctcgcctactcggggcttattggcacagtcatgacccccaactacatagactccagtagcctcagtgtggccccatggtgtgactgcagcaacagtgggaacgacctagaagagtgcttgaaatttttgaatttcttcaaggacaatacatgtcttaaaaatgcaattcaagcctttggcaatggctccgatgtgaccgtgtggcagccagccttcccagtacagaccaccactgccactaccaccactgccctccgggttaagaacaagcccctggggccagcagggtctgagaatgaaattcccactcatgttttgccaccgtgtgcaaatttacaggcacagaagctgaaatccaatgtgtcgggcaatacacacctctgtatttccaatggtaattatgaaaaagaaggtctcggtgcttccagccacataaccacaaaatcaatggctgctcctccaagctgtggtctgagcccactgctggtcctggtggtaaccgctctgtccaccctattatctttaacagaaacatcatag

SEQ ID NO: 6997 - DNA, 658 bp, synthetic construct
  misc_feature 1..658: note = Synthetic polypeptide
  source 1..658: mol_type = other DNA
gcacctgtaatcccaactactccagaggctgagatctcgccttgcggatttttttaccaactgccagccagagtcaaggtctgtcagcagctgtctaaaggaaaactacgctgactgcctcctcgcctactcggggcttattggcacagtcatgacccccaactacatagactccagtagcctcagtgtggccccatggtgtgactgcagcaacagtgggaacgacctagaagagtgcttgaaatttttgaatttcttcaaggacaatacatgtcttaaaaatgcaattcaagcctttggcaatggctccgatgtgaccgtgtggcagccagccttcccagtacagaccaccactgccactaccaccactgccctccgggttaagaacaagcccctggggccagcagggtctgagaatgaaattcccactcatgttttgccaccgtgtgcaaatttacaggcacagaagctgaaatccaatgtgtcgggcaatacacacctctgtatttccaatggtaattatgaaaaagaaggtctcggtgcttccagccacataaccacaaaatcaatggctgctcctccaagctgtggtctgagcccactgctggtcctggtggtaaccgctctgtccaccctattatctttaacagaaacatca

SEQ ID NO: 6998 - DNA, 654 bp, synthetic construct
  misc_feature 1..654: note = Synthetic polypeptide
  source 1..654: mol_type = other DNA
ggccaggtgcggtggctctcatctgtaatcccagcactctgggaggccgaggtgggtggatcacctgaggcctccccaaagccagtcctgtgtcaccaatcaaaggaaaggaagccgtcagcagagatgaacagaataaccaccaaggaagccacttcctcctgccccccaaaatcccctcttggagagacccgccagaaactctggaggagcctcaaaatgctccccgagagaggccagagggtccggcagcagctaaaaagccacctcgccactgtgaacttgtcgtcactcttggatgtccggagatccacggtgatctcaggccctgggaccggaaaaggcagccaagatcactcaggggatcccacctcgggggacagaggctacacggatccctgtgtggccacatctctcaaaagcccctcacagccccaggcaccaaaagacagaaaggtccccaccaggaaggccgagaggtcggtcagctgcattgaggtgaccccaggggacaggagttggcaccaaatggtagtgagagccctatcctcccaggagtccaagccagagcaccagggcttggcagagcctgagaacgaccagctcccggaggagtaccaacaaccgccaccctttgcccctgggtactgctag

SEQ ID NO: 6999 - DNA, 651 bp, synthetic construct
  misc_feature 1..651: note = Synthetic polypeptide
  source 1..651: mol_type = other DNA
ggccaggtgcggtggctctcatctgtaatcccagcactctgggaggccgaggtgggtggatcacctgaggcctccccaaagccagtcctgtgtcaccaatcaaaggaaaggaagccgtcagcagagatgaacagaataaccaccaaggaagccacttcctcctgccccccaaaatcccctcttggagagacccgccagaaactctggaggagcctcaaaatgctccccgagagaggccagagggtccggcagcagaaaagccacctcgccactgtgaacttgtcgtcactcttggatgtccggagatccacggtgatctcaggccctgggaccggaaaaggcagccaagatcactcaggggatcccacctcgggggacagaggctacacggatccctgtgtggccacatctctcaaaagcccctcacagccccaggcaccaaaagacagaaaggtccccaccaggaaggccgagaggtcggtcagctgcattgaggtgaccccaggggacaggagttggcaccaaatggtagtgagagccctatcctcccaggagtccaagccagagcaccagggcttggcagagcctgagaacgaccagctcccggaggagtaccaacaaccgccaccctttgcccctgggtactgctag

SEQ ID NO: 7000 - DNA, 498 bp, synthetic construct
  misc_feature 1..498: note = Synthetic polypeptide
  source 1..498: mol_type = other DNA
ggccaggtgcggtggctctcatctgtaatcccagcactctgggaggccgaggtgggtggatcacctgaggcctccccaaagccagtcctgtgtcaccaatcaaaggaaaggaagccgtcagcagagatgaacagaataaccaccaaggaagccacttcctcctgccccccaaaatcccctcttggagagacccgccagaaactctggaggagcctcaaaatgctccccgagagaggccagagggtccggcagcagctaaaaaagccacctcgccactgtgaacttgtcgtcactcttggatgtccggagatccacggtgatctcaggccctgggaccggaaaaggcagccaagatcactcaggggatcccacctcgggggacagaggctacacggatccctgtgtggccacatctctcaaaagcccctcacagccccaggcaccaaaagacagaaaggtccccaccaggaaggccgagaggtcggtcagctgcattga

SEQ ID NO: 7001 - DNA, 189 bp, synthetic construct
  misc_feature 1..189: note = Synthetic polypeptide
  source 1..189: mol_type = other DNA
ggccaggtgcggtggctctcatctgtaatcccagcactctgggaggccgaggtgggtggatcacctgaggcctccccaaagccagtcctgtgtcaccaatcaaaggaaaggaagccgtcagcagagatgaacagaataaccaccaaggaagccacttcctcctgccccccaaaatcccctcttggagag

SEQ ID NO: 7002 - DNA, 2471 bp, synthetic construct; identical to SEQ ID NO: 576
  misc_feature 1..2471: note = Synthetic polypeptide
  source 1..2471: mol_type = other DNA

SEQ ID NO: 7003 - DNA, 1514 bp, synthetic construct
  misc_feature 1..1514: note = Synthetic polypeptide
  source 1..1514: mol_type = other DNA
aaattggtaccaggaatgaggtactgcctaaagatacctaaaaatgtggaagcaattttggaactgggtaatgggcagtggctggaacagtttggagggctcagaagaagataggaagatgtgggaaagtttggaacttcctagagacttgttgaatagttttgaccaaaattctgatagtgacatggacaatgaagtctaggctgaggtggtgtcagatggagatgaggaactttttgggaactggagcagaggtcactcttgttatatcttagcaaagagactggtggcattttgctcccaccctagaggtctgtggaattttgaacttgagaaagatgatttagggtatctggcagaagaaatttctaagcagcaaagcattcaagaagtgacctggcttttggtaaaagtgtatgcccatattcgttcacaaagaaaaaatcagaaattggaagttaaagggaagcagaccgtaaaagtttgaaaaatttgcagcctgaccatgcagtaaaaaagaaaaacctatcttctggcaataaattcaagctggctgcagatatttgcataagtaatgaggagcccaatgttaatggcaaagacaatgaggaaagtacctccagggcatgtcagagatcttcacagcagcccctcccatcgcaagcctggcagcctagtagggaaaaatggttttatgggtcaggccagggccctgctcctctgttcagccttgggacattgtaccctgcatcccagccactccagctccagccgtggctaaaaggggccaaggtacagctcaaactatggcttaagaggatgcaatccccaagtcttacagcttccacgtggtgttgggcctgctgctgtgcaaaagacgagagttcagctttgggagcctccatctagatttcagagaatgtatggagatgtctgaatgtccaagcagaaatctgctgcaggtcagagccctcaaggagaacctctgctacagcagtgcagaggatcttaatgatttaagaatggagggagtaacaaccctggtaccttctgggagcaaatttaaccaaggccgtcctacttaccctgctgagcctcaggccaaggtcacactgaacatctgttcaaggtgtgccaggcttcaaggagacaacctggaagaaaggacagaagagtcactaccaatactccattctccagatgaaaaaatcccagattcattcgattccttgcctgggactgaagaagcactaatggaggagggtgacgaatttgagaaagcatctaaactaacaggacctggagaagcctccagtggagtaggacactcactgaaaaactacatggaagaagatgaatccttaaagcaattgcaggtagttcatcaaccatggatcttgccaagtgacacagaaagtgaaggagtggaagcagaacaagagaaacgttccgctgatcttcttctttgcgttccatgctcttcttgtcctacgctggtctactctggtttgtga

SEQ ID NO: 7004 - DNA, 1529 bp, synthetic construct
  misc_feature 1..1529: note = Synthetic polypeptide
  source 1..1529: mol_type = other DNA
aaattggtaccaggaatgaggtactgcctaaagatacctaaaaatgtggaagcaattttggaactgggtaatgggcagtggctggaacagtttggagggctcagaagaagataggaagatgtgggaaagtttggaacttcctagagacttgttgaatagttttgaccaaaattctgatagtgacatggacaatgaagtctaggctgaggtggtgtcagatggagatgaggaactttttgggaactggagcagaggtcactcttgttatatcttagcaaagagactggtggcattttgctcccaccctagaggtctgtggaattttgaacttgagaaagatgatttagggtatctggcagaagaaatttctaagcagcaaagcattcaagaagtgacctggcttttggtaaaagtgtatgcccatattcgttcacaaagaaaaaatcagaaattggaagttaaagggaagcagaccgtaaaagtttgaaaaatttgcagcctgaccatgcagtaaaaaagaaaaacctatcttctggcaataaattcaagctggctgcagatatttgcataagtaatgaggagcccaatgttaatggcaaagacaatgaggaaagtacctccagggcatgtcagagatcttcacagcagcccctcccatcgcaagcctggcagcctagtagggaaaaatggttttatgggtcaggccagggccctgctcctctgttcagccttgggacattgtaccctgcatcccagccactccagctccagccgtggctaaaaggggccaaggtacagctcaaactatggcttaagaggatgcaatccccaagtcttacagcttccacgtggtgttgggcctgctgctgtgcaaaagacgagagttcagctttgggagcctccatctagatttcagagaatgtatggagatgtctgaatgtccaagcagaaatctgctgcaggtcagagccctcaaggagaacctctgctacagcagtgcagaggatcttaatgatttaagaatggagggagtaacaaccctggtaccttctgggagcaaatttaaccaaggccgtcctacttaccctgctgagcctcaggccaaggtcacactgaacatctgttcaaggtgtgccaggcttcaaggagacaacctggaagaaaggacagaagagtcactaccaatactccattctccagatgaaaaaatcccagattcattcgattccttgcctgggactgaagaagcactaatggaggagggtgacgaatttgagaaagcatctaaactaacaggacctggagaagcctccagtggagtaggacactcactgaaaaactacatggaagaagatgaatccttaaagcaattgcaggtagttcatcaaccatggatcttgccaagtgacacagaaagtgaaggagtggaagcagaacaagagaaacacctactaaatcagaatctctgtggctgggactctgaattctgcatttttcatactttggcttctttcctcatctataaataa

SEQ ID NO: 7005 - DNA, 265 bp, synthetic construct
  misc_feature 1..265: note = Synthetic polypeptide
  source 1..265: mol_type = other DNA
gcacggagtcaaggcggataagaaggcggcacaagaaaagatgatccagcaggagcatgagcggcaggagcgggaagacgagcttcgagccatggcccgcaagatccgcatgaaggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattag

SEQ ID NO: 7006 - DNA, 21 bp, synthetic construct
  misc_feature 1..21: note = Synthetic polypeptide
  source 1..21: mol_type = other DNA
gcacggagtcaaggcggataa

SEQ ID NO: 7007 - DNA, 343 bp, synthetic construct
  misc_feature 1..343: note = Synthetic polypeptide
  source 1..343: mol_type = other DNA
gcacggagtcaaggcggataagaaggcggcacaagaaaagatgatccagcaggagcatgagcggcaggagcgggaagacgagcttcgagccatggcccgcaagatccgcatgaaggtgttggaagcacctgccctccctgagttcagtgtgtccagtgttcccggccagatgctcatgccatgccttcgcagggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattag

SEQ ID NO: 7008 - DNA, 753 bp, synthetic construct
  misc_feature 1..753: note = Synthetic polypeptide
  source 1..753: mol_type = other DNA
ttgttctaacaatcaggatgctccaaagtgacctgcatcagcttgacccgggaggcctccattaaactgtcacccttgcatggcaaacagatttccatccgctacctggacatgacggactgcttcgtgctggaggacgaaggcctgcacaccatcgcggcgcactgcacgcagctcacccacctctacctgcgccgctgcgtccgcctgaccgacgaaggcctgcgctacctggtgatctactgcgcctccatcaaggagctgagcgtcagcgactgccgcttcgtcagcgacttcggcctgcgggagatcgccaagctggagtcccgcctgcggtacctgagcatcgcgcactgcggccgggtcaccgacgtgggcatccgctacgtggccaagtactgcagcaagctgcgctacctcaacgcgaggggctgcgagggcatcacggaccacggtgtggagtacctcgccaagaactgcaccaaactcaaatccctggatatcggcaaatgccctttggtatccgacacgggcctggagtgcctggccctgaactgcttcaacctcaagcggctcagcctcaagtcctgcgagagcatcaccggccagggcttgcagatcgtggccgccaactgctttgacctccagacgctgaatgtccaggactgcgaggtctccgtggaggccctgcgctttgtcaaacgccactgcaagcgctgcgtcatcgagcacaccaacccggctttcttctga

SEQ ID NO: 7009 - DNA, 495 bp, synthetic construct
  misc_feature 1..495: note = Synthetic polypeptide
  source 1..495: mol_type = other DNA
gaaaacttatttgagggaataattgaggaaaacttccctggccttgctagagatctagacatccaactacaagaggctcaaagaacagccaggaaatttgtcacaaaaagatcatcacctaggcacatggtcatcaggttacataaaatcaagacaaaggaaagaatcttaagagctgtgaggcaaaagcatcagattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggactatgatgccttctttgaagccagagaaaataatgcagtgtatgccttcttaggcttgacagccccacctggttcaaaggaagcagaagtgcaagcaaagcagcaagcatga

SEQ ID NO: 7010 - DNA, 74 bp, synthetic construct
  misc_feature 1..74: note = Synthetic polypeptide
  source 1..74: mol_type = other DNA
ggccaggcatggtacttcacacctgtaatctcagcactttgggaggccgagatgatggacaagaaatagcctga

SEQ ID NO: 7011 - DNA, 504 bp, synthetic construct
  misc_feature 1..504: note = Synthetic polypeptide
  source 1..504: mol_type = other DNA
cagtgattcccaaatgtggctgacatcagaaatcacctgggaaagacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcg

SEQ ID NO: 7012 - DNA, 2153 bp, synthetic construct
  misc_feature 1..2153: note = Synthetic polypeptide
  source 1..2153: mol_type = other DNA
cagtgattcccaaatgtggctgacatcagaaatcacctgggaaagacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcgatcagctgttttacaccaagatcttcttggacccggagaagagggagcagatcaatatcaccctggaccaccgctgccgtatcttccagaacctggatggagccttggatgaggtcgtgctcaagtttgaaatgggccatgtgagagcgaggaacctggcctatgacaccctcccggtcctgatccatggcaacgggccaaccaagctgcagttgaactacctgggcaactacatcccgcgcttctggaccttcgaaacaggctgcaccgtgtgtgacgaaggcttgcgcagcctcaagggcattggggatgaagctctgcccacggtcctggtcggcgtgttcatcgaacagcccacgccgtttgtgtccctgttcttccagcggctcctgcggctccactacccccagaaacacatgcgacttttcatccacaaccacgagcagcaccacaaggctcaggtggaagagttcctggcacagcatggcagcgagtaccagtctgtgaagctggtgggccctgaggtgcggatggcgaatgcagatgccaggaacatgggcgcagacctgtgccggcaggaccgcagctgcacctactacttcagcgtggatgctgacgtggccctgaccgagcccaacagcctgcggctgctgatccaacagaacaagaacgtcattgccccgctgatgacccggcatgggaggctgtggtcgaacttctggggggctctcagtgcagatggctactatgcccgttccgaggactacgtggacattgtgcaggggcggcgtgttggtgtctggaatgtgccctatatttcaaacatctacttgatcaagggcagtgccctgcggggtgagctgcagtcctcagatctcttccaccacagcaagctggaccccgacatggccttctgtgccaacatccggcagcaggatgtgttcatgttcctgaccaaccggcacacccttggccatctgctctccctagacagctaccgcaccacccacctgcacaacgacctctgggaggtgttcagcaaccccgaggactggaaggagaagtacatccaccagaactacaccaaagccctggcagggaagctggtggagacgccctgcccggatgtctattggttccccatcttcacggaggtggcctgtgatgagctggtggaggagatggagcactttggccagtggtctctgggcaacaacaaggacaaccgcatccagggtggctacgagaacgtgccgactattgacatccacatgaaccagatcggctttgagcgggagtggcacaaattcctgctggagtacattgcgcccatgacggagaagctctaccccggctactacaccagggcccagtttgacctggcctttgtcgtccgctacaagcctgatgagcagccctcactgatgccacaccatgatgcctccaccttcaccatcaacatcgccctgaaccgagtcggggtggattacgagggcgggggctgtcggttcctgcgctacaactgttccatccgagccccaaggaagggctggaccctcatgcaccctggacgactcacgcattaccatgaggggctccccaccaccaggggcacccgctacatcgcagtctccttcgtcgatccctaa

SEQ ID NO: 7013 - DNA, 818 bp, synthetic construct
  misc_feature 1..818: note = Synthetic polypeptide
  source 1..818: mol_type = other DNA
cagtgattcccaaatgtggctgacatcagaaatcacctgggaaagacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcgatcagctgttttacaccaagatcttcttggacccggagaagagggagcagatcaatatcaccctggaccaccgctgccgtatcttccagaacctggatggagccttggtgtctccctggggccagggccaccttcctggggcctgctatgaactcactgcctctgtcctcacatctgagctcagcgtgatgccttcttttcctgctgtggtgctgcagttgaactacctgggcaactacatcccgcgcttctggaccttcgaaacaggctgcaccgtgtgtgacgaaggcttgcgcagcctcaagggcattggg

SEQ ID NO: 7014 - DNA, 1192 bp, synthetic construct
  misc_feature 1..1192: note = Synthetic polypeptide
  source 1..1192: mol_type = other DNA
gaccaggtgcagtggctcacgcctgtaatctcagcactttgggaggccgaggcgggcagatcacttgaggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaa

SEQ ID NO: 7015 - DNA, 454 bp, synthetic construct
  misc_feature 1..454: note = Synthetic polypeptide
  source 1..454: mol_type = other DNA
gaccaggtgcagtggctcacgcctgtaatctcagcactttgggaggccgaggcgggcagatcacttgaggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaacccataggcatgaaatga

SEQ ID NO: 7016 - DNA, 517 bp, synthetic construct
  misc_feature 1..517: note = Synthetic polypeptide
  source 1..517: mol_type = other DNA
cctcacctttccctcttccactttcgctcacctggattttgttccactgaaaccactgttacgaaagtcaccagtgacttccaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataa

SEQ ID NO: 7017 - DNA, 445 bp, synthetic construct; identical to SEQ ID NO: 744
  misc_feature 1..445: note = Synthetic polypeptide
  source 1..445: mol_type = other DNA

SEQ ID NO: 7018 - DNA, 59 bp, synthetic construct; identical to SEQ ID NO: 742
  misc_feature 1..59: note = Synthetic polypeptide
  source 1..59: mol_type = other DNA

SEQ ID NO: 7019 - DNA, 123 bp, synthetic construct; identical to SEQ ID NO: 743
  misc_feature 1..123: note = Synthetic polypeptide
  source 1..123: mol_type = other DNA

SEQ ID NO: 7020 - DNA, 977 bp, synthetic construct
  misc_feature 1..977: note = Synthetic polypeptide
  source 1..977: mol_type = other DNA
gtggaagcagcagctgggtactgggaggcctgagcttctgttccagcagcaccgttcactggaggcacatgacctcgggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaa

SEQ ID NO: 7021 - DNA, 881 bp, synthetic construct
  misc_feature 1..881: note = Synthetic polypeptide
  source 1..881: mol_type = other DNA
gtggaagcagcagctgggtactgggaggcctgagcttctgttccagcagcaccgttcactggaggcacatgacctcgggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggtaccgaacaaccctcctgctcacatgtcccccagggtttggggctcctctgtcccccgtcccgtga

SEQ ID NO: 7022 - DNA, 110 bp, synthetic construct
  misc_feature 1..110: note = Synthetic polypeptide
  source 1..110: mol_type = other DNA
gtggaagcagcagctgggtactgggaggcctgagcttctgttccagcagcaccgttcactggaggcacatgacctcgggcccctccagccagcgtcaggtgcagaatggc

SEQ ID NO: 7023 - DNA, 270 bp, synthetic construct
  misc_feature 1..270: note = Synthetic polypeptide
  source 1..270: mol_type = other DNA
gtggaagcagcagctgggtactgggaggcctgagcttctgttccagcagcaccgttcactggaggcacatgacctcgggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggc

SEQ ID NO: 7024 - DNA, 684 bp, synthetic construct
  misc_feature 1..684: note = Synthetic polypeptide
  source 1..684: mol_type = other DNA
gtggaagcagcagctgggtactgggaggcctgagcttctgttccagcagcaccgttcactggaggcacatgacctcgggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcag

SEQ ID NO: 7025 - DNA, 164 bp, synthetic construct; identical to SEQ ID NO: 831
  misc_feature 1..164: note = Synthetic polypeptide
  source 1..164: mol_type = other DNA

SEQ ID NO: 7026 - DNA, 193 bp, synthetic construct; identical to SEQ ID NO: 834
  misc_feature 1..193: note = Synthetic polypeptide
  source 1..193: mol_type = other DNA

SEQ ID NO: 7027 - DNA, 369 bp, synthetic construct; identical to SEQ ID NO: 6492
  misc_feature 1..369: note = Synthetic polypeptide
  source 1..369: mol_type = other DNA

SEQ ID NO: 7028 - DNA, 552 bp, synthetic construct
  misc_feature 1..552: note = Synthetic polypeptide
  source 1..552: mol_type = other DNA
gtcagtgagttggggaaggcagatccaccctaaatctgctgggcacaatctaatcagcttccagcaaatataaagcaggtagaaaaacgtgaaaaagagagacaggcctagcctcccactttacatgtttctcccgtgctggacgcttcctgcctttgaacgtcggacttcaagttcttcagttttgggacttggactggctctccttgatcctcagcttgcagaaagcctattgtggaaccttgtgatcatattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggactatgatgccttctttgaagccagagaaaataatgcagtgtatgccttcttaggcttgacagccccacctggttcaaaggaagcagaagtgcaagcaaagcagcaagcatga

SEQ ID NO: 7029 - DNA, 3052 bp, synthetic construct
  misc_feature 1..3052: note = Synthetic polypeptide
  source 1..3052: mol_type = other DNA
gactcagattcgaatcctggctttgctacatactacctgtgtgaggctctttaagcctcagtgacctcatctgtgaaatgtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtggtcccccctcgagtcactgagccccaccaacggccagtcccatgggacgtgcgggccgtttcagtggaagcggctgtgactccagcagagccctacgcccgggttctcttccacctcaaagggcaggattggccaccagggtctggcagcctgccctgtgcccggctccatgccacacaccctgccggcactgctcaccaagcctgccgcttccagccatccctgggcgcctgcgtggtggagctggagcttccctcgcactggttctcacaggcctccaccacacgggccgagctggcctacacgcttgagcctgcagctgagggccctgggggctgtggctccggcgaggagaacgaccctggggagcaggccctcccagtggggggtgtggagctgcgcccagcagaccccccgcagtaccaggaggtacctctggacgaggctgtgactctgcgggtgcctgacatgccagtgcggcccggccagctctttagtgctaccctcctgcttcggcacaacttcacagccagcctcctgaccctgcggatcaaggtgaagaaggggctgcatgtgacagccgcccgcccagcccagcccacactctggactgccaagctggaccgcttcaagggctccaggcaccacaccaccctcatcacctgccaccgtgctgggctcacagagccagattccagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggctgaggagctggtgaatacagcaccactgactggagtgccccagcatgtccccgtgcgccttgtcactgtggacggcgggggggccttggtggaggtgacagagcatgtcggctgcgagtctgccaacacacaggtcctgcaggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaagggcctgcggaacccgctgcagaggcgtcggatgaggccgagcggcgcgcccgtggctgccacctgcagtaccagcgggccggtgtgcgcttcctcgcccccttcgcggcccacccgctggacggcggccgccgcctcacgcacctgcttggccccgactggctgctagacgtgtcccacctcgtggcgccacacgcccgcgtgctggactcgcgtgtagcctctctggagggtggccgtgtcgtggtgggccgggagcccggtgtcacctccattgaggtgcgttccccactgtctgactccatcctgggggagcaggcgctggctgtgacggacgacaaggtctcagtgctggagctgagggtgcagccagtgatgggcatctcgctgaccttgagccggggcactgcccaccccggggaggtcacagctacgtgctgggcacagtcagcccttcccgccccaaagcaggaggtggccctctccctatggctgtccttctctgatcacactgtggccccagctgagctctacgaccgccgtgacctgggactgtccgtctcagccgaggagcctggtgccatcctgccagctgaggagcagggtgcccagctcggggtggtggtgagtggggcaggcgccgaggggctgccgctgcatgtggctctgcacccgcccgagccctgccgccggggccgccaccgtgtgcctctggcctctggcaccgcctggctggggctgccccctgcctccactccagcccctgctctcccatccagccctgcttggagcccaccagccacagaagccaccatgggtggtaaacggcaggtggcaggcagtgtcgggggcaacacaggtgtgaggggcaagtttgagcgggcagaggaggaggccaggaaggaggagaccgaagccagggaggaggaggaggaagaggaggaggagatggtccctgcccctcagcatgtcactgagctagagctgggcatgtacgccctgctgggagtcttctgcgtggccatcttcatcttcttggtcaatggtgtggtcttcgtcctgcgctatcagcgcaaagaacctcccgacagtgccactgaccccacctccccccagccccacaactgggtctggctgggcactgaccaggaggaactgagccgccagctggaccggcagtcccctggcccgcccaagggggaggggagctgcccctgtgagagtgggggaggaggggaggcccctaccctggcccctggccctcctgggggcaccaccagctcctcaagcaccctggcccgaaaggaggctggggggcggcggaagcgagtagagtttgtgacatttgcgccagcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctga

SEQ ID NO: 7030 - DNA, 3055 bp, synthetic construct
  misc_feature 1..3055: note = Synthetic polypeptide
  source 1..3055: mol_type = other DNA
gactcagattcgaatcctggctttgctacatactacctgtgtgaggctctttaagcctcagtgacctcatctgtgaaatgtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtggtcccccctcgagtcactgagccccaccaacggccagtcccatgggacgtgcgggccgtttcagtggaagcggctgtgactccagcagagccctacgcccgggttctcttccacctcaaagggcaggattggccaccagggtctggcagcctgccctgtgcccggctccatgccacacaccctgccggcactgctcaccaagcctgccgcttccagccatccctgggcgcctgcgtggtggagctggagcttccctcgcactggttctcacaggcctccaccacacgggccgagctggcctacacgcttgagcctgcagctgagggccctgggggctgtggctccggcgaggagaacgaccctggggagcaggccctcccagtggggggtgtggagctgcgcccagcagaccccccgcagtaccaggaggtacctctggacgaggctgtgactctgcgggtgcctgacatgccagtgcggcccggccagctctttagtgctaccctcctgcttcggcacaacttcacagccagcctcctgaccctgcggatcaaggtgaagaaggggctgcatgtgacagccgcccgcccagcccagcccacactctggactgccaagctggaccgcttcaagggctccaggcaccacaccaccctcatcacctgccaccgtgctgggctcacagagccagattccagcagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggctgaggagctggtgaatacagcaccactgactggagtgccccagcatgtccccgtgcgccttgtcactgtggacggcgggggggccttggtggaggtgacagagcatgtcggctgcgagtctgccaacacacaggtcctgcaggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaagggcctgcggaacccgctgcagaggcgtcggatgaggccgagcggcgcgcccgtggctgccacctgcagtaccagcgggccggtgtgcgcttcctcgcccccttcgcggcccacccgctggacggcggccgccgcctcacgcacctgcttggccccgactggctgctagacgtgtcccacctcgtggcgccacacgcccgcgtgctggactcgcgtgtagcctctctggagggtggccgtgtcgtggtgggccgggagcccggtgtcacctccattgaggtgcgttccccactgtctgactccatcctgggggagcaggcgctggctgtgacggacgacaaggtctcagtgctggagctgagggtgcagccagtgatgggcatctcgctgaccttgagccggggcactgcccaccccggggaggtcacagctacgtgctgggcacagtcagcccttcccgccccaaagcaggaggtggccctctccctatggctgtccttctctgatcacactgtggccccagctgagctctacgaccgccgtgacctgggactgtccgtctcagccgaggagcctggtgccatcctgccagctgaggagcagggtgcccagctcggggtggtggtgagtggggcaggcgccgaggggctgccgctgcatgtggctctgcacccgcccgagccctgccgccggggccgccaccgtgtgcctctggcctctggcaccgcctggctggggctgccccctgcctccactccagcccctgctctcccatccagccctgcttggagcccaccagccacagaagccaccatgggtggtaaacggcaggtggcaggcagtgtcgggggcaacacaggtgtgaggggcaagtttgagcgggcagaggaggaggccaggaaggaggagaccgaagccagggaggaggaggaggaagaggaggaggagatggtccctgcccctcagcatgtcactgagctagagctgggcatgtacgccctgctgggagtcttctgcgtggccatcttcatcttcttggtcaatggtgtggtcttcgtcctgcgctatcagcgcaaagaacctcccgacagtgccactgaccccacctccccccagccccacaactgggtctggctgggcactgaccaggaggaactgagccgccagctggaccggcagtcccctggcccgcccaagggggaggggagctgcccctgtgagagtgggggaggaggggaggcccctaccctggcccctggccctcctgggggcaccaccagctcctcaagcaccctggcccgaaaggaggctggggggcggcggaagcgagtagagtttgtgacatttgcgccagcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctga

SEQ ID NO: 7031 - DNA, 970 bp, synthetic construct; identical to SEQ ID NO: 711
  misc_feature 1..970: note = Synthetic polypeptide
  source 1..970: mol_type = other DNA

SEQ ID NO: 7032 - DNA, 701 bp, synthetic construct; identical to SEQ ID NO: 658
  misc_feature 1..701: note = Synthetic polypeptide
  source 1..701: mol_type = other DNA

SEQ ID NO: 7033 - DNA, 233 bp, synthetic construct; identical to SEQ ID NO: 856
  misc_feature 1..233: note = Synthetic polypeptide
  source 1..233: mol_type = other DNA

SEQ ID NO: 7034 - DNA, 308 bp, synthetic construct
  misc_feature 1..308: note = Synthetic polypeptide
  source 1..308: mol_type = other DNA
ggttgggcatggtggctcacgcctgtaatcccagcgctttggaaggccgaggtgagaaaaaccagaagcttgaagaccatagtgagaaaaactggaagcttgaagaccatggtgagaaaaaccagaagcttgaagaccatggtgtgaaaatccttgaacccacccaaatacctgctccaggtccagttcctgttccaggtcccaaaagccatccttctgcatcctcgggcaaactgctgcttccacagtttgggatggtcatcattttaatcagtgtttctgctataaatctctttgttgctctgtag

SEQ ID NO: 7035 - DNA, 341 bp, synthetic construct
  misc_feature 1..341: note = Synthetic polypeptide
  source 1..341: mol_type = other DNA
ggttgggcatggtggctcacgcctgtaatcccagcgctttggaaggccgaggtgagaaaaaccagaagcttgaagaccatagtgagaaaaactggaagcttgaagaccatggtgagaaaaaccagaagcttgaagaccatggtgtgaaaatccttgaacccacccaaatacctgaagataaaagtcaaggaaatatcaacaatcctactccaggtccagttcctgttccaggtcccaaaagccatccttctgcatcctcgggcaaactgctgcttccacagtttgggatggtcatcattttaatcagtgtttctgctataaatctctttgttgctctgtag

SEQ ID NO: 7036 - DNA, 374 bp, synthetic construct
  misc_feature 1..374: note = Synthetic polypeptide
  source 1..374: mol_type = other DNA
ggttgggcatggtggctcacgcctgtaatcccagcgctttggaaggccgaggtgagaaaaaccagaagcttgaagaccatagtgagaaaaactggaagcttgaagaccatggtgagaaaaaccagaagcttgaagaccatggtgtgaaaatccttgaacccacccaaatacctggaatgaaaattccagaaccttttccactacctgaagataaaagtcaaggaaatatcaacaatcctactccaggtccagttcctgttccaggtcccaaaagccatccttctgcatcctcgggcaaactgctgcttccacagtttgggatggtcatcattttaatcagtgtttctgctataaatctctttgttgctctgtag

SEQ ID NO: 7037 - DNA, 300 bp, synthetic construct
  misc_feature 1..300: note = Synthetic polypeptide
  source 1..300: mol_type = other DNA
ggttgggcatggtggctcacgcctgtaatcccagcgctttggaaggccgaggtgagaaaaaccagaagcttgaagaccatagtgagaaaaactggaagcttgaagaccatggtgagaaaaaccagaagcttgaagaccatggtgtgaaaatccttgaacccacccaaatacctggaatgaaaattccagaaccttttccactacctggaataaaaatgatacaactgaatgaaaaacctgaagataaaagtcaaggaaatatcaacaatcctactccaggtccagttcctgttccaggtc

SEQ ID NO: 7038 - DNA, 1084 bp, synthetic construct; identical to SEQ ID NO: 580
  misc_feature 1..1084: note = Synthetic polypeptide
  source 1..1084: mol_type = other DNA

SEQ ID NO: 7039 - DNA, 530 bp, synthetic construct
  misc_feature 1..530: note = Synthetic polypeptide
  source 1..530: mol_type = other DNA
tccctgtgctctagccatgccaggcctcttgtgtcatcaaatctgcctaattcttgcccatctcaggcattcagtacttgtattttcttttgcctacaatatttttggcatagctgactcatctttcactttcagtctgtcatctcctcaaagagatactctgatcatgctatctaaacaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaacccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaa

SEQ ID NO: 7040 - DNA, 299 bp, synthetic construct
  misc_feature 1..299: note = Synthetic polypeptide
  source 1..299: mol_type = other DNA
tccctgtgctctagccatgccaggcctcttgtgtcatcaaatctgcctaattcttgcccatctcaggcattcagtacttgtattttcttttgcctacaatatttttggcatagctgactcatctttcactttcagtctgtcatctcctcaaagagatactctgatcatgctatctaaacaatcatttggggaagaatctacagttgctgatggacagagtggatgaaatgagccaagatatagttaaatacaacacatacatgaggaatactagtaaacaacagcagcagaaacatcag

SEQ ID NO: 7041 - DNA, 428 bp, synthetic construct
  misc_feature 1..428: note = Synthetic polypeptide
  source 1..428: mol_type = other DNA
ggtggctcatgcctgtaatcccagcacttcaagaggctttggcggaagaatcgcttgagcccaggagtttgagaccagcctgggcaacacaagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatag

SEQ ID NO: 7042 - DNA, 435 bp, synthetic construct
  misc_feature 1..435: note = Synthetic polypeptide
  source 1..435: mol_type = other DNA
ggtggctcatgcctgtaatcccagcacttcaagaggctttggcggaagaatcgcttgagcccaggagtttgagaccagcctgggcaacacaagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttga

SEQ ID NO: 7043 - DNA, 657 bp, synthetic construct
  misc_feature 1..657: note = Synthetic polypeptide
  source 1..657: mol_type = other DNA
gagcaaagtcctatcaactcactatgccttggtttccccatctgtaaacgcagggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagcaggctagtgctctcagcttcccggcccccccttccaggccgctgccgcctgaccctgtgtccaagagactccagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctga

SEQ ID NO: 7044 - DNA, 729 bp, synthetic construct
  misc_feature 1..729: note = Synthetic polypeptide
  source 1..729: mol_type = other DNA
gagcaaagtcctatcaactcactatgccttggtttccccatctgtaaacgcagggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagcaggctagtgctctcagcttcccggcccccccttccaggccgctgccgcctgaccctgtgtccaagagactccaggctgagctggctgaccgacccaatccccctacccgccctctgcccgctgacccggtggtgagaagcccgaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctga

SEQ ID NO: 7045 - DNA, 654 bp, synthetic construct
  misc_feature 1..654: note = Synthetic polypeptide
  source 1..654: mol_type = other DNA
gagcaaagtcctatcaactcactatgccttggtttccccatctgtaaacgcagggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaaggctgagctggctgaccgacccaatccccctacccgccctctgcccgctgacccggtggtgagaagcccgaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctga

SEQ ID NO: 7046 - DNA, 456 bp, synthetic construct
  misc_feature 1..456: note = Synthetic polypeptide
  source 1..456: mol_type = other DNA
gagcaaagtcctatcaactcactatgccttggtttccccatctgtaaacgcagggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagtctcaggggccagccaagcccccacccccaaggaagccactgcctgccgacccccagggccggtgcccatcgggtgacctgcccggcccaggggctggaatcccgcccctag

SEQ ID NO: 7047 - DNA, 528 bp, synthetic construct
  misc_feature 1..528: note = Synthetic polypeptide
  source 1..528: mol_type = other DNA
gagcaaagtcctatcaactcactatgccttggtttccccatctgtaaacgcagggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacaggctagtgctctcagcttcccggcccccccttccaggccgctgccgcctgaccctgtgtccaagagactccagtctcaggggccagccaagcccccacccccaaggaagccactgcctgccgacccccagggccggtgcccatcgggtgacctgcccggcccaggggctggaatcccgcccctag

SEQ ID NO: 7048 - DNA, 726 bp, synthetic construct
  misc_feature 1..726: note = Synthetic polypeptide
  source 1..726: mol_type = other DNA
gagcaaagtcctatcaactcactatgccttggtttccccatctgtaaacgcagggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaaggctagtgctctcagcttcccggcccccccttccaggccgctgccgcctgaccctgtgtccaagagactccaggctgagctggctgaccgacccaatccccctacccgccctctgcccgctgacccggtggtgagaagcccgaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctga

SEQ ID NO: 7049 - DNA, 606 bp, synthetic construct
  misc_feature 1..606: note = Synthetic polypeptide
  source 1..606: mol_type = other DNA
gagcaaagtcctatcaactcactatgccttggtttccccatctgtaaacgcagggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagcaggctagtgctctcagcttcccggcccccccttccaggccgctgccgcctgaccctgtgtccaagagactccaggctgagctggctgaccgacccaatccccctacccgccctctgcccgctgacccggtggtgagaagcccgaaggtaacggtggggggagagaagggcacggcctctccccccacctag

SEQ ID NO: 7050 - DNA, 531 bp, synthetic construct
  misc_feature 1..531: note = Synthetic polypeptide
  source 1..531: mol_type = other DNA
gagcaaagtcctatcaactcactatgccttggtttccccatctgtaaacgcagggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaaggctgagctggctgaccgacccaatccccctacccgccctctgcccgctgacccggtggtgagaagcccgaaggtaacggtggggggagagaagggcacggcctctccccccacctag

SEQ ID NO: 7051 - DNA, 582 bp, synthetic construct
  misc_feature 1..582: note = Synthetic polypeptide
  source 1..582: mol_type = other DNA
gagcaaagtcctatcaactcactatgccttggtttccccatctgtaaacgcagggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctga

SEQ ID NO: 7052 - DNA, 367 bp, synthetic construct; identical to SEQ ID NO: 548
  misc_feature 1..367: note = Synthetic polypeptide
  source 1..367: mol_type = other DNA

SEQ ID NO: 7053 - DNA, 3274 bp, synthetic construct
  misc_feature 1..3274: note = Synthetic polypeptide
  source 1..3274: mol_type = other DNA
gtatatggtagacacacccgacagcaataatttaacttgagcataccctgaggatgatcctgtatggcagttgcacctgaatatgtgtttggagttcagagcgtgcccaacccagagataaattccttgtctgtgaggaacatctgagctctgggcccttcctgtggaacatcagcatacaggggagtgaggctctttgttttgcgttaaatgaaggttgccaggtggaggttgttaggaggagggagtgaagtgaaaatgctatataaactgcatgctttttgcatgcagtggtggttcttctgtccagcacatggctactgcatcatccctgtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggatacaattatccatcagttgcagaaacgttatgcagacttgctaatttacacatatgttggagacatcttaattgccttaaaccccttccagaatctaagcatatactctccacagttttccagactttatcatggggtgaaacgcgcctccaatcccccccacatatttgcatcagcagatgctgcttaccagtgcatggttactctcagcaaagaccagtgcattgtcatcagcggagagagtggctctgggaagacagaaagcgcccacctgattgttcagcatttgactttcttgggaaaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgagagagaaaaattttcatatattttactatatttatgctggtcttcatcaccaaaagaagctttctgatttcagacttcctgaggaaaaacctcctaggtacatagctgatgaaactggaagggtgatgcacgacataacttccaaggagtcttacagaagacaattcgaagcaattcagcattgcttcaggattatagggttcacggacaaagaggtgcactcagtgtacagaattttggctgggattttgaatattgggaacattgagttcgcagctatttcctctcaacatcagactgataaaagtgaggtgcccaatgctgaagctttgcaaaatgctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatgtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcagatggaatatcagaatgaaggcattgatgctgtacccgtggaatatgaggacaaccgcccgctcttggacatgttcctccagaaacccctgggactgcttgcacttttggatgaggaaagtcggtttccccaagcaactgaccagaccctggttgataaatttgaagataatctacgatgcaaatacttctggaggcccaaaggagtggaactgtgctttggcattcagcattatgctggaaaggtattatatgatgcttctggggttcttgagaaaaatagagacactctccctgccgatgtggttgtggtcctgagaacgtcagaaaacaagcttcttcagcagctcttctcaatccctctgaccaaaacaggtaatttggcccagacaagagctaggataacagtggcctcaagttctttgcctccacatttcagtgctgggaaagccaaggtggacactctggaggtgatacggcatccggaagaaaccaccaacatgaagaggcaaactgtggcttcttacttccggtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtattattacttggcattcacagcacatcaaacacctcttgctagcaaagagagctgtgtggctatcttggaaaagtccagattagatcactgggtactgggaaaaacaaaggtttttctcaaatattaccatgttgagcaattaaatttgctgcttcgagaagtcataggcagagtggttgtgctgcaggcatataccaaggggtggcttggagccaggagatacaaaagggtcagagagaagagagagaagggagccattgccatccagtcaggggacacttcaaaccaaagcagtgggccacattcccccgtcgcagcaggtacgaggggaagtgccgaggttcaagactgcagcgagcctggtgaccataaagttctcaggggctctgtacatcgtaggagccattcacaagcagaatccaacaatggccgtacacagacttcaagcaactctcctgctgtcacagagaaaaatgggcattcacaagcccagagttctccaaaagggtgcgatatcttcgcaggacatgcaaacaagcactcggtttctgggactgatttgctgtcttctcggatatgccatcctgctccagatcagcaaggattgagtctctggggagcccctcaaaagcctgcctttccacattacggatgtaacttttatgggttcagaaaatggtcttgcacagaagcatcgaacacctcgccgacgatgtcagcagcccaaaatgctgagtag

SEQ ID NO: 7054 - DNA, 3544 bp, synthetic construct
  misc_feature 1..3544: note = Synthetic polypeptide
  source 1..3544: mol_type = other DNA
gtatatggtagacacacccgacagcaataatttaacttgagcataccctgaggatgatcctgtatggcagttgcacctgaatatgtgtttggagttcagagcgtgcccaacccagagataaattccttgtctgtgaggaacatctgagctctgggcccttcctgtggaacatcagcatacaggggagtgaggctctttgttttgcgttaaatgaaggttgccaggtggaggttgttaggaggagggagtgaagtgaaaatgctatataaactgcatgctttttgcatgcagtggtggttcttctgtccagcacatggctactgcatcatccctgtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggatacaattatccatcagttgcagaaacgttatgcagacttgctaatttacacatatgttggagacatcttaattgccttaaaccccttccagaatctaagcatatactctccacagttttccagactttatcatggggtgaaacgcgcctccaatcccccccacatatttgcatcagcagatgctgcttaccagtgcatggttactctcagcaaagaccagtgcattgtcatcagcggagagagtggctctgggaagacagaaagcgcccacctgattgttcagcatttgactttcttgggaaaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgagagagaaaaattttcatatattttactatatttatgctggtcttcatcaccaaaagaagctttctgatttcagacttcctgaggaaaaacctcctaggtacatagctgatgaaactggaagggtgatgcacgacataacttccaaggagtcttacagaagacaattcgaagcaattcagcattgcttcaggattatagggttcacggacaaagaggtgcactcagtgtacagaattttggctgggattttgaatattgggaacattgagttcgcagctatttcctctcaacatcagactgataaaagtgaggtgcccaatgctgaagctttgcaaaatgctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatgtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcagatggaatatcagaatgaaggcattgatgctgtacccgtggaatatgaggacaaccgcccgctcttggacatgttcctccagaaacccctgggactgcttgcacttttggatgaggaaagtcggtttccccaagcaactgaccagaccctggttgataaatttgaagataatctacgatgcaaatacttctggaggcccaaaggagtggaactgtgctttggcattcagcattatgctggaaaggtattatatgatgcttctggggttcttgagaaaaatagagacactctccctgccgatgtggttgtggtcctgagaacgtcagaaaacaagcttcttcagcagctcttctcaatccctctgaccaaaacaggtaatttggcccagacaagagctaggataacagtggcctcaagttctttgcctccacatttcagtgctgggaaagccaaggtggacactctggaggtgatacggcatccggaagaaaccaccaacatgaagaggcaaactgtggcttcttacttccggtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtattattacttggcattcacagcacatcaaacacctcttgctagcaaagagagctgtgtggctatcttggaaaagtccagattagatcactgggtactgggaaaaacaaaggtttttctcaaatattaccatgttgagcaattaaatttgctgcttcgagaagtcataggcagagtggttgtgctgcaggcatataccaaggggtggcttggagccaggagatacaaaagggtcagagagaagagagagaagggagccattgccatccagtcagcctggagaggatatgatgctcggaggaaatttaagaaaataagcaacagaaggaatgagtctgctgctcataatcaagcaggggacacttcaaaccaaagcagtgggccacattcccccgtcgcagcaggtacgaggggaagtgccgaggttcaagactgcagcgagcctggtgaccataaagttctcaggggctctgtacatcgtaggagccattcacaagcagaatccaacaatggccgtacacagacttcaagcaactctcctgctgtcacagagaaaaatgggcattcacaagcccagagttctccaaaagggtgcgatatcttcgcaggacatgcaaacaagcactcggtttctgggactgatttgctgtcttctcggatatgccatcctgctccagatcagcaaggattgagtctctggggagcccctcaaaagcctggttcagaaaatggtcttgcacagaagcatcgaacacctcgccgacgatgtcagcagcccaaaatgctgagtagccctgaggacaccatgtactataaccagttaaatggaactctagaatatcaagggagcaagaggaagccaagaaaacttggccaaatcaaagtacttgatggggaagatgaatattacaaatctctgtcaccagtggactgtatccctgaggagaacaactcagcccacccttcctttttttcttcatcctcaaaaggagactcttttgctcaacattaa

SEQ ID NO: 7055 - DNA, 3463 bp, synthetic construct
  misc_feature 1..3463: note = Synthetic polypeptide
  source 1..3463: mol_type = other DNA
gtatatggtagacacacccgacagcaataatttaacttgagcataccctgaggatgatcctgtatggcagttgcacctgaatatgtgtttggagttcagagcgtgcccaacccagagataaattccttgtctgtgaggaacatctgagctctgggcccttcctgtggaacatcagcatacaggggagtgaggctctttgttttgcgttaaatgaaggttgccaggtggaggttgttaggaggagggagtgaagtgaaaatgctatataaactgcatgctttttgcatgcagtggtggttcttctgtccagcacatggctactgcatcatccctgtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggatacaattatccatcagttgcagaaacgttatgcagacttgctaatttacacatatgttggagacatcttaattgccttaaaccccttccagaatctaagcatatactctccacagttttccagactttatcatggggtgaaacgcgcctccaatcccccccacatatttgcatcagcagatgctgcttaccagtgcatggttactctcagcaaagaccagtgcattgtcatcagcggagagagtggctctgggaagacagaaagcgcccacctgattgttcagcatttgactttcttgggaaaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgagagagaaaaattttcatatattttactatatttatgctggtcttcatcaccaaaagaagctttctgatttcagacttcctgaggaaaaacctcctaggtacatagctgatgaaactggaagggtgatgcacgacataacttccaaggagtcttacagaagacaattcgaagcaattcagcattgcttcaggattatagggttcacggacaaagaggtgcactcagtgtacagaattttggctgggattttgaatattgggaacattgagttcgcagctatttcctctcaacatcagactgataaaagtgaggtgcccaatgctgaagctttgcaaaatgctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatgtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcagatggaatatcagaatgaaggcattgatgctgtacccgtggaatatgaggacaaccgcccgctcttggacatgttcctccagaaacccctgggactgcttgcacttttggatgaggaaagtcggtttccccaagcaactgaccagaccctggttgataaatttgaagataatctacgatgcaaatacttctggaggcccaaaggagtggaactgtgctttggcattcagcattatgctggaaaggtattatatgatgcttctggggttcttgagaaaaatagagacactctccctgccgatgtggttgtggtcctgagaacgtcagaaaacaagcttcttcagcagctcttctcaatccctctgaccaaaacaggtaatttggcccagacaagagctaggataacagtggcctcaagttctttgcctccacatttcagtgctgggaaagccaaggtggacactctggaggtgatacggcatccggaagaaaccaccaacatgaagaggcaaactgtggcttcttacttccggtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtattattacttggcattcacagcacatcaaacacctcttgctagcaaagagagctgtgtggctatcttggaaaagtccagattagatcactgggtactgggaaaaacaaaggtttttctcaaatattaccatgttgagcaattaaatttgctgcttcgagaagtcataggcagagtggttgtgctgcaggcatataccaaggggtggcttggagccaggagatacaaaagggtcagagagaagagagagaagggagccattgccatccagtcaggggacacttcaaaccaaagcagtgggccacattcccccgtcgcagcaggtacgaggggaagtgccgaggttcaagactgcagcgagcctggtgaccataaagttctcaggggctctgtacatcgtaggagccattcacaagcagaatccaacaatggccgtacacagacttcaagcaactctcctgctgtcacagagaaaaatgggcattcacaagcccagagttctccaaaagggtgcgatatcttcgcaggacatgcaaacaagcactcggtttctgggactgatttgctgtcttctcggatatgccatcctgctccagatcagcaaggattgagtctctggggagcccctcaaaagcctggttcagaaaatggtcttgcacagaagcatcgaacacctcgccgacgatgtcagcagcccaaaatgctgagtagccctgaggacaccatgtactataaccagttaaatggaactctagaatatcaagggagcaagaggaagccaagaaaacttggccaaatcaaagtacttgatggggaagatgaatattacaaatctctgtcaccagtggactgtatccctgaggagaacaactcagcccacccttcctttttttcttcatcctcaaaaggagactcttttgctcaacattaa

SEQ ID NO: 7056 - DNA, 2807 bp, synthetic construct
  misc_feature 1..2807: note = Synthetic polypeptide
  source 1..2807: mol_type = other DNA
gtatatggtagacacacccgacagcaataatttaacttgagcataccctgaggatgatcctgtatggcagttgcacctgaatatgtgtttggagttcagagcgtgcccaacccagagataaattccttgtctgtgaggaacatctgagctctgggcccttcctgtggaacatcagcatacaggggagtgaggctctttgttttgcgttaaatgaaggttgccaggtggaggttgttaggaggagggagtgaagtgaaaatgctatataaactgcatgctttttgcatgcagtggtggttcttctgtccagcacatggctactgcatcatccctgtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggatacaattatccatcagttgcagaaacgttatgcagacttgctaatttacacatatgttggagacatcttaattgccttaaaccccttccagaatctaagcatatactctccacagttttccagactttatcatggggtgaaacgcgcctccaatcccccccacatatttgcatcagcagatgctgcttaccagtgcatggttactctcagcaaagaccagtgcattgtcatcagcggagagagtggctctgggaagacagaaagcgcccacctgattgttcagcatttgactttcttgggaaaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgagagagaaaaattttcatatattttactatatttatgctggtcttcatcaccaaaagaagctttctgatttcagacttcctgaggaaaaacctcctaggtacatagctgatgaaactggaagggtgatgcacgacataacttccaaggagtcttacagaagacaattcgaagcaattcagcattgcttcaggattatagggttcacggacaaagaggtgcactcagtgtacagaattttggctgggattttgaatattgggaacattgagttcgcagctatttcctctcaacatcagactgataaaagtgaggtgcccaatgctgaagctttgcaaaatgctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatgtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcagatggaatatcagaatgaaggcattgatgctgtacccgtggaatatgaggacaaccgcccgctcttggacatgttcctccagaaacccctgggactgcttgcacttttggatgaggaaagtcggtttccccaagcaactgaccagaccctggttgataaatttgaagataatctacgatgcaaatacttctggaggcccaaaggagtggaactgtgctttggcattcagcattatgctggaaaggtattatatgatgcttctggggttcttgagaaaaatagagacactctccctgccgatgtggttgtggtcctgagaacgtcagaaaacaagcttcttcagcagctcttctcaatccctctgaccaaaacaggtaatttggcccagacaagagctaggataacagtggcctcaagttctttgcctccacatttcagtgctgggaaagccaaggtggacactctggaggtgatacggcatccggaagaaaccaccaacatgaagaggcaaactgtggcttcttacttccggtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtattattacttggcattcacagcacatcaaacacctcttgctagcaaagagagctgtgtggctatcttggaaaagtccagattagatcactgggtactgggaaaaacaaaggtttttctcaaatattaccatgttgagcaattaaatttgctgcttcgagaagtcataggcagagtggttgtgctgcaggcatataccaaggggtggcttggagccaggagatacaaaagggtcagagagaagagagagaagggagccattgccatccagtcag

SEQ ID NO: 7057 - DNA, 601 bp, synthetic construct
  misc_feature 1..601: note = Synthetic polypeptide
  source 1..601: mol_type = other DNA
gtatatggtagacacacccgacagcaataatttaacttgagcataccctgaggatgatcctgtatggcagttgcacctgaatatgtgtttggagttcagagcgtgcccaacccagagataaattccttgtctgtgaggaacatctgagctctgggcccttcctgtggaacatcagcatacaggggagtgaggctctttgttttgcgttaaatgaaggttgccaggtggaggttgttaggaggagggagtgaagtgaaaatgctatataaactgcatgctttttgcatgcagtggtggttcttctgtccagcacatggctactgcatcatccctgtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggtactaaatatttag

SEQ ID NO: 7058 - DNA, 1317 bp, synthetic construct
  misc_feature 1..1317: note = Synthetic polypeptide
  source 1..1317: mol_type = other DNA
gaccaggcatggtggctcacgcctgtaatcccagcactttgggaggccgaggagggcagatcacgaggtcaagagatcgagaccattctggctaacatgatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtga

SEQ ID NO: 7059 - DNA, 363 bp, synthetic construct
  misc_feature 1..363: note = Synthetic polypeptide
  source 1..363: mol_type = other DNA
ctttagatatttgcagattccatttttcactcatcaggcgtgggctttgccactaggcaggtgggaaatgtgaccaaaccaacggtaattatcagtcaagaaggagacaaagtggtcatcaggactctcagcacattcaagaacacggagattagtttccagctgggagaagagtttgatgaaaccactgcagatgatagaaactgtaagtctgttgttagcctggatggagacaaacttgttcacatacagaaatgggatggcaaagaaacaaattttgtaagagaaattaaggatggcaaaatggttatgacccttacttttggtgatgtggttgctgttcgccactatgagaaggcataa

SEQ ID NO: 7060 - DNA, 465 bp, synthetic construct
  misc_feature 1..465: note = Synthetic polypeptide
  source 1..465: mol_type = other DNA
ctttagatatttgcagattccatttttcactcatcaggcgtgggctttgccactaggcaggtgggaaatgtgaccaaaccaacggtaattatcagtcaagaaggagacaaagtggtcatcaggactctcagcacattcaagaacacggagattagtttccagctgggagaagagtttgatgaaaccactgcagatgatagaaactgtaagtctgttgttagcctggatggagacaaacttgttcacatacagaaatgggatggcaaagaaacaaattttgtaagagaaattaaggatggcaaaatggttatggtaagtaatgacaattctccattcttccttgtttttttctcctctccgcacacctctcacctccttccttcttcttccctcctccttccattcttcctccttccttccttctttaataatacatcactggcaaggttctttaactatatgtaa

SEQ ID NO: 7061 - DNA, 423 bp, synthetic construct; identical to SEQ ID NO: 6550
  misc_feature 1..423: note = Synthetic polypeptide
  source 1..423: mol_type = other DNA

SEQ ID NO: 7062 - DNA, 414 bp, synthetic construct; identical to SEQ ID NO: 602
  misc_feature 1..414: note = Synthetic polypeptide
  source 1..414: mol_type = other DNA

SEQ ID NO: 7063 - DNA, 434 bp, synthetic construct; identical to SEQ ID NO: 603
  misc_feature 1..434: note = Synthetic polypeptide
  source 1..434: mol_type = other DNA

SEQ ID NO: 7064 - DNA, 1615 bp, synthetic construct
  misc_feature 1..1615: note = Synthetic polypeptide
  source 1..1615: mol_type = other DNA
gaagaatcaaatagacgaaaaaaaaatgataaagggatgtcaccaccaatcccacagaaatacaaactaccatcagagaatactataaacacctctaagcaaataaactagtaaatctagaagaaatggataaattactggacgcatacaccctcccaagactaaaccaggaagaagttgaatctctgaatagaccaatgacaggctctgaaattgaggcaataattaatagcctaccaaccaaaaaaagtacaggaccagatggattcacagccaaattctaccagagggacaaggaggagctggtaccattccttctgaaactattccaatcgatagaaaaagagggaatcctccctaactcattttatgaggccagcatcatcctgataccaaagcctggcagagacacaacaaaaaaagagaattttagaccaatattcctgatgaacattgatgcaaaattccttaataaaatactggcaaaccaaatccagcagcacatcaaaaagcttatccaccatgatcaagtgggcttcatccctgggatgcaaggctggttcaacatatgcaaatcaatcaacgtaatccagcatataaacagaaccaaagacaaaaaccacatgattttctcaatagatgtagaaaaggcctttgacaaaattcaacagcccttcatgctaaaaactctcaataaattaggtattgatgggatgtatctcagaataataagagctatttatgacaaacccacagccaatatcatactgaatgggcaaaacctggaagcattccacttgaaaactggcacaagacagggatgccctctctcaccactcctattcaatgtagtgttggaagttctggccagggcaatcaggcaggagaaagaaataaagggcattcaattaggaaaagaggatgtcacactgtcccagtttgcagacgacgttattgtatatttagaaaaccccattgtgtcagcccaaaatctccttaagctgataagcaacttcagcaaagtctcaggatacaaaatcaatgtgcaaaaatcacaagcattcttatacaccaataacagacaaacagagagcaaatcatgagtgaactcccattcacaattgcttcaaagagaataaaatacctaggaatccaacttacaagggatgtgaaggacctcttaaaggggaactataaaccactgctcaatgaaataagaggacacaaacaaatggaagaatattccatgctcatgggtaggaagaatcaatatcgtgaaaatggccatactgcccaaggaataactgtgtttatcaatatttgggctcttcaccacaacccctatttctgggaagaccctcaggtctttaaccccttgagattctccagggaaaattctgaaaaaatacatccctatgccttcataccattctcagctggattaaggaactgcattgggcagcattttgccataattgagtgtaaagtggcagtggcattaactctgctccgcttcaagctggctccagaccactcaaggcctccccagcctgttcgtcaagttgtcctcaagtccaagaatggaatccatgtgtttgcaaaaaaagtttgctaa

SEQ ID NO: 7065 - DNA, 784 bp, synthetic construct; identical to SEQ ID NO: 6798
  misc_feature 1..784: note = Synthetic polypeptide
  source 1..784: mol_type = other DNA

SEQ ID NO: 7066 - DNA, 569 bp, synthetic construct
  misc_feature 1..569: note = Synthetic polypeptide
  source 1..569: mol_type = other DNA
ctcaacaaccagctcattgccatgcacatactcttgtagtgagatttctgaccaaacggttcatctgggaatatgatcccaccctcgaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaacatcctagatgagatcaaaaagcccaagaatgtgactctcatcttggttggaaacaaagctgacttggaccactccaggcaggttagcacagaagaaggagagaagctggccacagaattggcttgtgctttttacgagtgctctgcctgcactggagaagggaacatcacagagatattctatgaattgtgtcgagaggtgcgtcgccggaggatggtgcagggcaagacgaggcgacgcagctccaccacgcatgtcaagcaagccattaacaagatgctcaccaaaatcagtagttag

SEQ ID NO: 7067 - DNA, 270 bp, synthetic construct
  misc_feature 1..270: note = Synthetic polypeptide
  source 1..270: mol_type = other DNA
ctcaacaaccagctcattgccatgcacatactcttgtagtgagatttctgaccaaacggttcatctgggaatatgatcccaccctcgaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaaca

SEQ ID NO: 7068 - DNA, 182 bp, synthetic construct
  misc_feature 1..182: note = Synthetic polypeptide
  source 1..182: mol_type = other DNA
ctcaacaaccagctcattgccatgcacatactcttgtagtgagatttctgaccaaacggttcatctgggaatatgatcccaccctcgaatcaacctaccgacaccaagcaaccatcgatgatgaagttgtttccatggagatactagacactgctggtcaggtgaataaagagttcagctaa

SEQ ID NO: 7069 - DNA, 85 bp, synthetic construct
  misc_feature 1..85: note = Synthetic polypeptide
  source 1..85: mol_type = other DNA
ctcaacaaccagctcattgccatgcacatactcttgtagtgagatttctgaccaaacggttcatctgggaatatgatcccaccct

SEQ ID NO: 7070 - DNA, 1797 bp, synthetic construct
  misc_feature 1..1797: note = Synthetic polypeptide
  source 1..1797: mol_type = other DNA
tgaaaccaccttgctaaggttatgatggttagagaaatccaacacagctgactttatcttgcttctgaccccagaagctgactatctgctcattcctgggtgtaggtcaagctaactaaaaaggagtttagtttacagtttaactttaaagcaaggatgataatagtcccttcctgaaactggtccccttcttgcttgggaactgaaactgcatttgtaaaactaatgaaagtcaataagattagaattatgataagggcctgaattctgctaagtaataagcacagtgaagaagagataaccagccattgttccctagcttggttactgctggaggtcacaagatttgagataacatcaccactgtaaaccctaagatgggtttttgagatatttttcagacctttgcattctggtaaactgactgatgccatctggaccatgactcataccaaggaacagactcaactcgtcctgtgacccccacctagaaactgactcagcacgtgaagacagttccaacactccagtgatttcatctccaaccaatcagtagcatacattccctggccctcagcttgccaaattatccttaaaaaccctgggctccaagctttcgaggaggtggatttgagagatacctcccctccttctgctcagctgccttgcagtaattaaactctttctctgctgcaacacccctactgttctccgtgtattggcttttctgggcagcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaa

SEQ ID NO: 7071 - DNA, 1081 bp, synthetic construct
  misc_feature 1..1081: note = Synthetic polypeptide
  source 1..1081: mol_type = other DNA
tgaaaccaccttgctaaggttatgatggttagagaaatccaacacagctgactttatcttgcttctgaccccagaagctgactatctgctcattcctgggtgtaggtcaagctaactaaaaaggagtttagtttacagtttaactttaaagcaaggatgataatagtcccttcctgaaactggtccccttcttgcttgggaactgaaactgcatttgtaaaactaatgaaagtcaataagattagaattatgataagggcctgaattctgctaagtaataagcacagtgaagaagagataaccagccattgttccctagcttggttactgctggaggtcacaagatttgagataacatcaccactgtaaaccctaagatgggtttttgagatatttttcagacctttgcattctggtaaactgactgatgccatctggaccatgactcataccaaggaacagactcaactcgtcctgtgacccccacctagaaactgactcagcacgtgaagacagttccaacactccagtgatttcatctccaaccaatcagtagcatacattccctggccctcagcttgccaaattatccttaaaaaccctgggctccaagctttcgaggaggtggatttgagagatacctcccctccttctgctcagctgccttgcagtaattaaactctttctctgctgcaacacccctactgttctccgtgtattggcttttctgggcagcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgc

SEQ ID NO: 7072 - DNA, 1059 bp, synthetic construct
  misc_feature 1..1059: note = Synthetic polypeptide
  source 1..1059: mol_type = other DNA
tgaaaccaccttgctaaggttatgatggttagagaaatccaacacagctgactttatcttgcttctgaccccagaagctgactatctgctcattcctgggtgtaggtcaagctaactaaaaaggagtttagtttacagtttaactttaaagcaaggatgataatagtcccttcctgaaactggtccccttcttgcttgggaactgaaactgcatttgtaaaactaatgaaagtcaataagattagaattatgataagggcctgaattctgctaagtaataagcacagtgaagaagagataaccagccattgttccctagcttggttactgctggaggtcacaagatttgagataacatcaccactgtaaaccctaagatgggtttttgagatatttttcagacctttgcattctggtaaactgactgatgccatctggaccatgactcataccaaggaacagactcaactcgtcctgtgacccccacctagaaactgactcagcacgtgaagacagttccaacactccagtgatttcatctccaaccaatcagtagcatacattccctggccctcagcttgccaaattatccttaaaaaccctgggctccaagctttcgaggaggtggatttgagagatacctcccctccttctgctcagctgccttgcagtaattaaactctttctctgctgcaacacccctactgttctccgtgtattggcttttctgggcagcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaacccataggcatgaaatga

SEQ ID NO: 7073 - DNA, 909 bp, synthetic construct
  misc_feature 1..909: note = Synthetic polypeptide
  source 1..909: mol_type = other DNA
tgaaaccaccttgctaaggttatgatggttagagaaatccaacacagctgactttatcttgcttctgaccccagaagctgactatctgctcattcctgggtgtaggtcaagctaactaaaaaggagtttagtttacagtttaactttaaagcaaggatgataatagtcccttcctgaaactggtccccttcttgcttgggaactgaaactgcatttgtaaaactaatgaaagtcaataagattagaattatgataagggcctgaattctgctaagtaataagcacagtgaagaagagataaccagccattgttccctagcttggttactgctggaggtcacaagatttgagataacatcaccactgtaaaccctaagatgggtttttgagatatttttcagacctttgcattctggtaaactgactgatgccatctggaccatgactcataccaaggaacagactcaactcgtcctgtgacccccacctagaaactgactcagcacgtgaagacagttccaacactccagtgatttcatctccaaccaatcagtagcatacattccctggccctcagcttgccaaattatccttaaaaaccctgggctccaagctttcgaggaggtggatttgagagatacctcccctccttctgctcagctgccttgcagtaattaaactctttctctgctgcaacacccctactgttctccgtgtattggcttttctgggcagcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatatt

SEQ ID NO: 7074 - DNA, 346 bp, synthetic construct
  misc_feature 1..346: note = Synthetic polypeptide
  source 1..346: mol_type = other DNA
cccccagatgacatttggcaatgtttgggagacatctttggttgtcataactgtcgagctctactggcatctaaatgccctggctaaagctactgtgaaagaacttgcctcactgcacggcaccaagtacacatatggcccgggagctacaacaatctatcctgctgctgggggctctgacgactgggcttatgaccaaggaatcagatattccttcacctttgaacttcgagatacaggcagatatggctttctccttccagaatcccagatccgggctacctgcgaggagaccttcctggcaatcaagtatgttgccagctacgtcctggaacacctgtactag

SEQ ID NO: 7075 - DNA, 1256 bp, synthetic construct
  misc_feature 1..1256: note = Synthetic polypeptide
  source 1..1256: mol_type = other DNA
tgcagcatcttgagcctcactctagacctgaatcagaacctgcatttgaacaatatcccagaggctacatggtaatgggagattctttcaacacttctctcttcaagcagacattccaaagaatctttactaaagattttaatggagatttccgaatggcatttggtgctactttggacgtaaagacctctcgggaactgaagattgcaggagccattggtccatgcgtatctctgaatgtgaaaggaccgtgtgtgtcagaaaatgagcttggtgttggtggcacgagtcagtggaaaatctgtggcctagatcctacatctacacttggcatctattttgaagttgtcaatcagcacaacaccccgatcccccaaggaggcagaggagccatccagtttgtcacgcattatcagcactccagcacccagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagccagtactcttggatagcagcagcattctagctgacagaattttgctgatggatactttctttcaaattgtcatttatcttggtgagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaa

SEQ ID NO: 7076 - DNA, 342 bp, synthetic construct
  misc_feature 1..342: note = Synthetic polypeptide
  source 1..342: mol_type = other DNA
tgatatggtttggctgtgtccccacccaaatttcatcttcaattgtagctcccataattctctcatgttgtgggagggacctggtgggagataattgaatcatgagggcagttttccccatgctgttctcgtggtagtgagtaagtctcacaagatctgatggttttataagaggttttccctttctctgggctctcatttctctctgtggtctgctgccacgattgtgaggcctccccagccacgcgaaactaacttgagagagatttgctgggataaggcgggacatttctttgatctcccggacttcttatcgtggaaggcaacaggtgtcacagcacg

SEQ ID NO: 7077 - DNA, 1516 bp, synthetic construct
  misc_feature 1..1516: note = Synthetic polypeptide
  source 1..1516: mol_type = other DNA
tgatatggtttggctgtgtccccacccaaatttcatcttcaattgtagctcccataattctctcatgttgtgggagggacctggtgggagataattgaatcatgagggcagttttccccatgctgttctcgtggtagtgagtaagtctcacaagatctgatggttttataagaggttttccctttctctgggctctcatttctctctgtggtctgctgccacgattgtgaggcctccccagccacgcgaaactaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatgagaaccactggatatctgtatattccggctttggcagcgttgcactctcccagttctctactctcccctcaggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactga

SEQ ID NO: 7078 - DNA, 1444 bp, synthetic construct
  misc_feature 1..1444: note = Synthetic polypeptide
  source 1..1444: mol_type = other DNA
tgatatggtttggctgtgtccccacccaaatttcatcttcaattgtagctcccataattctctcatgttgtgggagggacctggtgggagataattgaatcatgagggcagttttccccatgctgttctcgtggtagtgagtaagtctcacaagatctgatggttttataagaggttttccctttctctgggctctcatttctctctgtggtctgctgccacgattgtgaggcctccccagccacgcgaaactaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactga

SEQ ID NO: 7079 - DNA, 1312 bp, synthetic construct
  misc_feature 1..1312: note = Synthetic polypeptide
  source 1..1312: mol_type = other DNA
tgatatggtttggctgtgtccccacccaaatttcatcttcaattgtagctcccataattctctcatgttgtgggagggacctggtgggagataattgaatcatgagggcagttttccccatgctgttctcgtggtagtgagtaagtctcacaagatctgatggttttataagaggttttccctttctctgggctctcatttctctctgtggtctgctgccacgattgtgaggcctccccagccacgcgaaactaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacagtgggggaaatag

SEQ ID NO: 7080 - DNA, 1083 bp, synthetic construct
  misc_feature 1..1083: note = Synthetic polypeptide
  source 1..1083: mol_type = other DNA
ggctgggtgcagtggttcacgcctgttaatcccagcactttgggaggccaaggcatagcccttttgtacctgcagttgtaccgggtcacatgtgaccaaacctacctgctccgatccctggattacgtaaaaagaacacttcggaatctgaatggccgcagggtcaccttcctctgtggggatgctggccccctggctgttggagctgtgatttatcacaaactcagaagtgactgtgagtcccaggaatgtgtcacaaaacttttgcagctccagagatcggttgtctgccaagaatcagaccttcctgatgagctgctttatggacgggcaggttatctgtatgccttactgtacctgaacacagagataggtccaggcaccgtgtgtgagtcagctattaaagaggtagtcaatgctattattgaatcgggtaagactttgtcaagggaagaaagaaaaacggagcgctgcccgctgttgtaccagtggcaccggaagcagtacgttggagcagcccatggcatggctggaatttactatatgttaatgcagccggcagcaaaagtggaccaagaaaccttgacagaaatggtgaaacccagtattgattatgtgcgccacaaaaaattccgatctgggaattacccatcatcattaagcaatgaaacagaccggctggtgcactggtgccacggcgccccgggggtcatccacatgctcatgcaggcgtacaaggtctttaaggaggagaagtacttgaaagaggccatggagtgtagcgatgtgatttggcagcgaggtttgctgcggaagggctacgggatatgccatgggactgctggcaacggctattccttcctgtccctttaccgtctcacgcaggataagaagtacctctaccgagcttgcaagtttgcagagtggtgtctagattacggagcacacgggtgccgcattcctgacagaccctattcgctctttgaaggcatggctggcgctattcactttctctctgatgtcctgggaccagagacatcacggtttccagcatttgaacttgactcttcgaagagggattaa

SEQ ID NO: 7081 - DNA, 1873 bp, synthetic construct
  misc_feature 1..1873: note = Synthetic polypeptide
  source 1..1873: mol_type = other DNA
tgatatgtttggatttgtgtccccacctaaatctcatgatgaattgtaattcccaatgttgggggagggacctggtgggaggtgattggatcttggcggtggttttcccccttgctgttcttgtgacagtgagtgagttctcatgagatctgatggtttaaaagtgtgtggcacttccccattcactcactgtctctcctgccgtcacgtgaagatgtgcttgcttcccctttgcccttccaccgtaattgtgagtttcctgaggcctcaccagccatgcctcctgtacagcctgtggaactgtgagtcaattcaacctcttttcttcataaatcatgcattctcagcaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctga

SEQ ID NO: 7082 - DNA, 977 bp, synthetic construct
  misc_feature 1..977: note = Synthetic polypeptide
  source 1..977: mol_type = other DNA
tgtgacagattgcattttcagaaaaatggccaaaatacctcccatcccaaatgctttcttgcaagtgactttgacactcatcccattatagatgtggagatctgtgtgctctccattggatctcggcaaggctgtgactggaggatgcaaagctttgtgactttcaaggcagatcataaatggcagtaagacttctacctcattctgttgggatgcttactctaaacccgaccaccttgtcaggaggaaacccagacagcccatggagaagcccatatggagaggagccaaggcccacagccctagccgagctcccagctgaaagccagtaccaatttgccagccttgaatcactgacgtttcaggatgtggccgtggacttcaccagagaggagtgggaccagctgtaccctgcccaaaagaacctctatcgagacgtgatgctggagaactacaggaatctagttgcactggggtatcagctttgtaagccagaggtaatcgcgcagttggagctagaggaagaatgggtgatagaaagagacagcctgctggatactcatccaggtgaccaaagccacgtaatgtccgtagttcgctcatccgtccatgccagatggattgtggggaaggtgattgggacaaaaatgcaaaagactgctaaagtgagagtgaccaggcttgttctggatccctatttattaaagtattttaataagcggaaaacctactttgctcacgatgcccttcagcagtgcacagttggggatattgtgcttctcagagctttacctgttccacgagcaaagcatgtgaaacatgaactggctgagatcgttttcaaagttggaaaagtcatagatccagtgacaggaaagccctgtgctggaactacctacctggagagtccgttgagttcggaaaccacccagctaagcaaaaatctggaagaactcaatatctcttcagcacagtga

SEQ ID NO: 7083 - DNA, 1592 bp, synthetic construct
  misc_feature 1..1592: note = Synthetic polypeptide
  source 1..1592: mol_type = other DNA
tgtgacagattgcattttcagaaaaatggccaaaatacctcccatcccaaatgctttcttgcaagtgactttgacactcatcccattatagatgtggagatctgtgtgctctccattggatctcggcaaggctgtgactggaggatgcaaagctttgtgactttcaaggcagatcataaatggcagtaagacttctacctcattctgttgggatgcttactctaaacccgaccaccttgtcaggaggaaacccagacagcccatggagaagcccatatggagaggagccaaggcccacagccctagccgagctcccagctgaaagccagtaccaatttgccagccttgaatcactgacgtttcaggatgtggccgtggacttcaccagagaggagtgggaccagctgtaccctgcccaaaagaacctctatcgagacgtgatgctggagaactacaggaatctagttgcactggggtatcagctttgtaagccagaggtaatcgcgcagttggagctagaggaagaatgggtgatagaaagagacagcctgctggatactcatccagatggagaaaacagacccgaaatcaaaaagtcaaccacaagccagaatatttctgatgaaaatcaaacccatgagatgataatggagagactcgcaggagacagcttctggtactccatcctaggaggactctgggattttgattaccatccagagtttaaccaagaaaaccacaagagatatttaggacaagtaactttgacccacaaaaagatcacacaggagagaagccttgagtgtaataaatttgcagaaaactgtaatctgaactcaaaccttatgcagcagagaattccttccattaaaatacccctgaattctgacacacagggaaacagcatcaaacataattcagacttgatttactatcagggaaattatgtaagagagactccctatgaatatagtgagtgtggaaaaatcttcaatcaacatattcttcttactgatcatattcatactgcagagaaacccagtgagtgtgggaaggccttcagccacacctcatctcttagccagcctcagatgttgcttacaggagagaagccctataagtgtgatgaatgtggaaaaagattcagccagaggatacatctcattcaacatcagagaattcacacaggagaaaagccttttatatgcaatggatgtgggaaagccttccgtcagcattcatcctttactcaacatctgaggattcatactggagaaaagccctataaatgtaatcaatgtggtaaagcttttagccgcatcacatcccttactgaacatcatagacttcataccggagagaaaccttacgaatgtggtttctgtggcaaagccttcagtcagaggacacatctgaatcaacatgaaagaactcatacaggagagaaaccctataaatgtaatgaatgcgggaaagcctttagccagagtgcacaccttaatcaacacaggaaaatccatactcgggagaaattatgtgaatataaatgtgagcaaactgttcgccacagtccttcatttagcagcacataa

SEQ ID NO: 7084 - DNA, 999 bp, synthetic construct
  misc_feature 1..999: note = Synthetic polypeptide
  source 1..999: mol_type = other DNA
gctgagtgtggtagctcatgcctgtaatcccagcactttgggaggctgaggcaggaaaatcacttgagcccaagagtttgagaccagcctggacaacaaagcaagactccatctctacaaagaataaataaataagttagccagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagtgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtga

SEQ ID NO: 7085 - DNA, 733 bp, synthetic construct
  misc_feature 1..733: note = Synthetic polypeptide
  source 1..733: mol_type = other DNA
gctgagtgtggtagctcatgcctgtaatcccagcactttgggaggctgaggcaggaaaatcacttgagcccaagagtttgagaccagcctggacaacaaagcaagactccatctctacaaagaataaataaataagttagccagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatgg

SEQ ID NO: 7086 - DNA, 179 bp, synthetic construct
  misc_feature 1..179: note = Synthetic polypeptide
  source 1..179: mol_type = other DNA
gcatttcttctaaaaatacaaaaatacatgatgtgcctgtggccctagctactcaggaagttgagtttcgtgtggctgatcaaagaaagaaggcatacgcagatttctacagaaactacgatgtcatgaaagattttgaggagatgaggaaggctggtatctttcagagtgtaaagtaa

SEQ ID NO: 7087 - DNA, 2025 bp, synthetic construct
  misc_feature 1..2025: note = Synthetic polypeptide
  source 1..2025: mol_type = other DNA
ggccgtgcagggcggctcacgcctgtaatcccagcactttgggaggctgaggtgggcagatcacctgaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaagctaaagccagggggttagaattccagatctccaacgtgaagtttgaagatgtgggaggcaatgatatgacattaaaagaggtctgcaagatgctcatacacatgcgtcacccggaggtgtaccaccacctgggcgtcgtgccccctcgtggagttctccttcatggaccaccaggctgtgggaagacattacttgcacatgcaattgctggggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagacaggggcaagtgtccgagtggtgaatcagctacttacagagatggatggtctggaagcacgccagcaggtttttattatggcagccactaacaggccagatataattgaccctgcaatcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaaggtgaactcaaggttagtcataagcattttgaagaagctttcaagaaagtaagatcatctatatcaaaaaaggatcaaatcatgtatgaacgtttgcaggagtccctcagccggtga

SEQ ID NO: 7088 - DNA, 1542 bp, synthetic construct
  misc_feature 1..1542: note = Synthetic polypeptide
  source 1..1542: mol_type = other DNA
ggccgtgcagggcggctcacgcctgtaatcccagcactttgggaggctgaggtgggcagatcacctgaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaagctaaagccagggggttagaattccagatctccaacgtgaagtttgaagatgtgggaggcaatgatatgacattaaaagaggtctgcaagatgctcatacacatgcgtcacccggaggtgtaccaccacctgggcgtcgtgccccctcgtggagttctccttcatggaccaccaggctgtgggaagacattacttgcacatgcaattgctggggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagatataa

SEQ ID NO: 7089 - DNA, 345 bp, synthetic construct
  misc_feature 1..345: note = Synthetic polypeptide
  source 1..345: mol_type = other DNA
ggccgtgcagggcggctcacgcctgtaatcccagcactttgggaggctgaggtgggcagatcacctgaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaaggaggtctgcaagatgctcatacacatgcgtcacccggaggtgtaccaccacctgggcgtcgtgccccctcgtggagttctccttcatggaccaccaggctgtgggaagacattacttgcacatgcaattgctggggaacttga

SEQ ID NO: 7090 - DNA, 280 bp, synthetic construct
  misc_feature 1..280: note = Synthetic polypeptide
  source 1..280: mol_type = other DNA
ggccgtgcagggcggctcacgcctgtaatcccagcactttgggaggctgaggtgggcagatcacctgaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaagctaaagccagggggttagaattccagatctccaacgtgaagtttgaagatgtgggaggcaatgatatgacattaaaag

SEQ ID NO: 7091 - DNA, 279 bp, synthetic construct
  misc_feature 1..279: note = Synthetic polypeptide
  source 1..279: mol_type = other DNA
ggccgtgcagggcggctcacgcctgtaatcccagcactttgggaggctgaggtgggcagatcacctgaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaagctaaagccagggggttagaattccagatctccaacgtgaagtttgaagatgtgggaggcaatgatatgacattaaaa

SEQ ID NO: 7092 - DNA, 1022 bp, synthetic construct; identical to SEQ ID NO: 590
  misc_feature 1..1022: note = Synthetic polypeptide
  source 1..1022: mol_type = other DNA

SEQ ID NO: 7093 - DNA, 347 bp, synthetic construct; identical to SEQ ID NO: 591
  misc_feature 1..347: note = Synthetic polypeptide
  source 1..347: mol_type = other DNA

SEQ ID NO: 7094 - DNA, 1109 bp, synthetic construct; identical to SEQ ID NO: 592
  misc_feature 1..1109: note = Synthetic polypeptide
  source 1..1109: mol_type = other DNA

SEQ ID NO: 7095 - DNA, 85 bp, synthetic construct; identical to SEQ ID NO: 601
  misc_feature 1..85: note = Synthetic polypeptide
  source 1..85: mol_type = other DNA

SEQ ID NO: 7096 - DNA, 269 bp, synthetic construct; identical to SEQ ID NO: 600
  misc_feature 1..269: note = Synthetic polypeptide
  source 1..269: mol_type = other DNA

SEQ ID NO: 7097 - DNA, 1248 bp, synthetic construct
  misc_feature 1..1248: note = Synthetic polypeptide
  source 1..1248: mol_type = other DNA
gagaaagcacaggctctggcatcagaaaatgttagcaaactcaagaaacttgaatatttgaatttagctttaaacaacattgaaaaaatagaaaacttggaaggatgtgaagagctggcaaaacttgacctgactgtgaatttcattggagagctgagcagcattaaaaacttgcagcacaatatccatctgaaggagctctttctcatggggaacccatgtgcttcctttgaccactatagggagttcgtggtagcaactcttccacaattaaagtggttggatggtaaagaaatagagccttcagaaaggattaaggcattgcaggactattcagtaattgaaccacaaatcagagagcaggaaaaagatcactgtcttaaacgagccaaactcaaggaagaggctcagaggaaacaccaagaagaggataaaaatgaagacaagagaagtaacgcaggctttgatggacgttggtacacagacatcaatgctactctttcctctttagagagcaaagaccacctacaggcaccagacacagaggaacacaacacaaagaaattagacaacagtgaagatgacttggaattctggaataagccctgtttgtttactcctgaatcaagattggaaactcttagacacatggaaaaacaacggaagaaacaggaaaaattaagtgaaaaaaagaagaaagtgaaaccacccaggactttgatcactgaagatgggaaagccctaaatgtgaatgagcccaaaattgacttctctttgaaagataacgaaaagcagatcatcctggaccttgctgtctataggtatatggatacctctttaatcgatgttgatgtgcaaccaacttacgtgcgagtaatgatcaaaggaaagccatttcagcttgtccttcctgcagaagtgaaacccgatagtagttctgctaaaagatctcagacaacgggtcatttggtcatctgcatgcccaaggtaggagaagtaatcacaggtggtcagcgagcattcaaatctatgaaaactacctcggacaggagcagagaacaaacaaatacaagaagcaagcacatggagaaactagaagtagaccctagcaagcactcattccctgatgtgactaacatagttcaagagaaaaaacacacacccagaagacgacctgaacccaaaattataccaagtgaggaagacccaacctttgaagacaaccctgaagtgcctccgctgatttga

SEQ ID NO: 7098 - DNA, 1083 bp, synthetic construct
  misc_feature 1..1083: note = Synthetic polypeptide
  source 1..1083: mol_type = other DNA
gagaaagcacaggctctggcatcagaaaatgttagcaaactcaagaaacttgaatatttgaatttagctttaaacaacattgaaaaaatagaaaacttggaaggatgtgaagagctggcaaaacttgacctgactgtgaatttcattggagagctgagcagcattaaaaacttgcagcacaatatccatctgaaggagctctttctcatggggaacccatgtgcttcctttgaccactatagggagttcgtggtagcaactcttccacaattaaagtggttggatggtaaagaaatagagccttcagaaaggattaaggcattgcaggactattcagtaattgaaccacaaatcagagagcaggaaaaagatcactgtcttaaacgagccaaactcaaggaagaggctcagaggaaacaccaagaagaggataaaaatgaagacaagagaagtaacgcaggctttgatggacgttggtacacagacatcaatgctactctttcctctttagagagcaaagaccacctacaggcaccagacacagaggaacacaacacaaagaaattagacaacagtgaagatgacttggaattctggaataagccctgtttgtttactcctgaatcaagattggaaactcttagacacatggaaaaacaacggaagaaacaggaaaaattaagtgaaaaaaagaagaaagtgaaaccacccaggactttgatcactgaagatgggaaagccctaaatgtgaatgagcccaaaattgacttctctttgaaagataacgaaaagcagatcatcctggaccttgctgtctataggtatatggatacctctttaatcgatgttgatgtgcaaccaacttacgtgcgagtaatgatcaaaggaaagcttgtccttcctgcagaagtgaaacccgatagtagttctgctaaaagatctcagacaacgggtcatttggtcatctgcatgcccaaggtaggagaagtaatcacaggtggtcagcgagcattcaaatctatgaaaactacctcggacaggagcagagaacaaacaaatacaagctattctactggattctag

SEQ ID NO: 7099 - DNA, 117 bp, synthetic construct
  misc_feature 1..117: note = Synthetic polypeptide
  source 1..117: mol_type = other DNA
gagaaagcacaggctctggcatcagaaaatgttagcaaactcaagaaacttgaatatttgaatttagctttaaacaacattgaaaaaatagaaaacttggaagatgtcatctattga

SEQ ID NO: 7100 - DNA, 225 bp, synthetic construct
  misc_feature 1..225: note = Synthetic polypeptide
  source 1..225: mol_type = other DNA
ggctgggcgtggtggctcacgcctgtaatcccagcactttgggaggctgaggcgggctgatcacaagagctaaaacgtcatcctctcttcagtgatgtggactgggaaaatctgcagcatcagactatgcctttcatcccccagccagatgatgaaacagatacctcctattttgaagccaggaatactgctcagcacctgactgtatctggatttagtctgtag

SEQ ID NO: 7101 - DNA, 287 bp, synthetic construct
  misc_feature 1..287: note = Synthetic polypeptide
  source 1..287: mol_type = other DNA
cccactgctgtttaaagtattttaataagcggaaaacctactttgctcacgatgcccttcagcagtgcacagttggggatattgtgcttctcagagctttacctgttccacgagcaaagcatgtgaaacatgaactggctgagatcgttttcaaagttggaaaagtcatagatccagtgacaggaaagccctgtgctggaactacctacctggagagtccgttgagttcggaaaccacccagctaagcaaaaatctggaagaactcaatatctcttcagcacagtga

SEQ ID NO: 7102 - DNA, 281 bp, synthetic construct
  misc_feature 1..281: note = Synthetic polypeptide
  source 1..281: mol_type = other DNA
cccactgctgtttaaagtattttaataagcggaaaacctactttgctcacgatgcccttcagcagtgcacagttggggatattgtgcttctcagagctttacctgttccacgagcaaagcatgtgaaacatgaactggctgagatcgttttcaaagttggaaaagtcatagatccagtgacaggaaagccctgtgctggaactacctacctggagagtccgttgagttcggaaaccacccagctaagcaaaaatctggaagaactcaatatctcttcagca

SEQ ID NO: 7103 - DNA, 634 bp, synthetic construct
  misc_feature 1..634: note = Synthetic polypeptide
  source 1..634: mol_type = other DNA
tcatctgacctattactcagcttgcctgcctgccccatcctgcctcaggttccggtgttcctcctgccagcgaagttgggcttccgcccaagtgcagattctgtgccacacgtactgggagcactggacatcccagggtcaggtgcgtatgaggctctttggccaaaggtgccagaagtgctcctggtcccaatatgagatgcctgagttctcctcggatagcaccatgaggattctgagcaacctggtgcagcatatactgaagaaatactatggaaatggcacgaggaagtctccagaaatgccagtaatcctggaagtgtccctggaaggatcccatgacacagccaattgtgaggcatgcactttgggcatctgtggacagggcttaaaaagctgcatgacaaagccgtccaaatccctactcccccacctaaagactgggaattcctcacctggaattggtgctgtgtacctcgcaaaccaagccaagaaccagtcagctgaggcaaaagaggctaaggggagtgggtatgagaaattagggcccagtcgagacccagatccactgaacatctgtgtctttattttgctgcttgtatttattgtagtcaaatgctttacatcagaatga

SEQ ID NO: 7104 - DNA, 527 bp, synthetic construct
  misc_feature 1..527: note = Synthetic polypeptide
  source 1..527: mol_type = other DNA
aataatattcatctcacatgcctatggtgaggattaactaagcggccctccaggcactgaagcgtaagaagaggtatgagaagcagctggcgcagatcgacggcacattatcaaccatcgagttccagcgggaggccctggagaatgccaacaccaacaccgaggtgctcaagaacatgggctatgccgccaaggccatgaaggcggcccatgacaacatggacatcgataaagttgatgagttaatgcaggacattgctgaccagcaagaacttgcagaggagatttcaacagcaatttcgaaacctgtagggtttggagaagagtttgacgaggatgagctcatggcggaattagaagaactagaacaggaggaactagacaagaatttgctggaaatcagtggacccgaaacagtccctctaccaaatgttccctctatagccctaccatcaaaacccgccaagaagaaagaagaggaggacgacgacatgaaggaattggagaactgggctggatccatgtaa

SEQ ID NO: 7105 - DNA, 353 bp, synthetic construct
  misc_feature 1..353: note = Synthetic polypeptide
  source 1..353: mol_type = other DNA
gccaggtgcaggggctcacgcccataatcccagcactctgggaggcccaggtgggtggatctcgtgaggtcaggagttcaagaccagcttggccaacatggtgaaaccccatctctgctgaaaatacaaaagttagctgaaaatacaaaagtggcacatgcctgtaatgccagctactggggaggctgaggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaa

SEQ ID NO: 7106 - DNA, 811 bp, synthetic construct
  misc_feature 1..811: note = Synthetic polypeptide
  source 1..811: mol_type = other DNA
ttcaagccttgccactcgttagccctgtgaccagggcacgtcacttgacctctctgatcctcagttccctcatctgtaaggcaactccaacctggtctacgccatcatccgcaagcgcagcatcttccaccagctggccaacctgcccacggacccgcccaccattcacaaggccctgcagcggcgccggcggacacctgagcccttgtctcgcaccggctcccaggagggcacctccatggagggctcccgccccgctgcccctgcagagccaggcaccctcaagaccagtctggtggctactccaggcattgacaagctgaccgagaagtcccaggtgtcagaggatggcaccttgcggtccctggaacctgagccccagcagagcttggaggatggcagcccggctaagggggagcccagccaggcatggagggagcagcggcgaccgtccacctcatcagccagtgggcagtggagcccaacgccagagtgggtcctctcctggaagtcgaagctgccgctgcagaccatcatgaggctgctgcaggtgctggttccgcaggtggagaagatctgcattgacaagggcctgacggatgagtctgagatcctgcggttcctgcagcatggcaccctggtggggctgctgcccgtgccccaccccatcctcatccgcaagtaccaggccaactcgggcactgccatgtggttccgcacctacatgtggggcgtcatctatctgaggaatgtggacccccctgtctggtacgacaccgacgtgaagctgtttgagatacagcgggtgtga

SEQ ID NO: 7107 - DNA, 1340 bp, synthetic construct
  misc_feature 1..1340: note = Synthetic polypeptide
  source 1..1340: mol_type = other DNA
aaagcctgagcttttgaatcagactacttgggttggagtcctggctcctatgctgaatagccttgaagagtttgggcaaggtactgaaccccacattcctctttcacaagattgtggacctgacagtgggcaacaacaaaactctcctggacattgacaacactcgcatgacactggatgacttcaggataaagtttgagatggagcaaaacctgcggcaaggagtggatgctgacatcaatggcctgcggcaggtgctggacaatctgaccatggagaagtctgacctggagatgcagtatgagactctgcaggaggagctgatggccctcaagaagaatcataaggaggagatgagtcagctgactgggcagaacagtggagatgtcaatgtggagataaacgttgctcctggcaaagatctcaccaagaccctcaatgacatgcgtcaggagtatgagcagctcattgctaagaacagaaaggacatcgagaatcaatatgagactcagataacccagatcgagcatgaggtatccagtagtggtcaggaggtgcagtccagtgccaaggaggtgacccagctccggcacggtgtccaggagttggagattgagctgcagtctcagctcagcaagaaagcagctctggagaagagcttggaagacacgaagaaccgctactgtggccagctgcagatgatccaggagcagatcagtaacttggaggcccagatcactgacgtccggcaagagatcgagtgccagaatcaggaatacagccttctgctcagcattaagatgcggctggagaaggaaatcgagacctaccacaacctccttgagggaggccaggaagactttgaatcctccggagctggaaaaattggccttggaggtcgaggaggaagtggaggcagttatggaagaggatccaggggaggaagtggaggcagctatggtggaggaggaagtggaggtggctatggtggaggaagtgggtccaggggaggaagtggaggcagctacggtggaggaagtggttctggaggaggtagtggaggtggctatggtggaggaagtggaggtggccatagcggaggaagtggaggtggtcatagtggaggaagtgggggcaactatggaggaggaagtggctctggaggaggaagtgggggtggctatggtggaggaagtgggtccaggggaggaagtggaggcagccatggtggaggaagtggttttggaggtgaaagtggaggcagctacggaggcggtgaagaagcgagtggaagtggtggcggctacggaggaggaagcggaaaatcatcccattcctag

SEQ ID NO: 7108 - DNA, 557 bp, synthetic construct
  misc_feature 1..557: note = Synthetic polypeptide
  source 1..557: mol_type = other DNA
ctggggatttggaaacttggtcctgctcaatgctgctgctacttcttgtgtcactatgaacccatcttttggcctctctgagtctcagaaaattcatagaaatgggtttcattgatgaaaaaagaatagccatatggggctggtcctatggaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagactaa

SEQ ID NO: 7109 - DNA, 463 bp, synthetic construct
  misc_feature 1..463: note = Synthetic polypeptide
  source 1..463: mol_type = other DNA
tagtcccagctaatcggagaaactcaggatgaaaaccgaagaagaggcccggactcatacagagattgaaatgttccttagaaaggagcagcagaaacttgaggagaggctggagttctggatggagaaatacgataaggacacagaaatgaaacagaatgaactaaatgctctcaaagccacaaaggccagtgacttagcacaccttcaagacctggcaaagatgataagagagtatgaacaggtcatcattgaagatcgtatagaaaaggagaggagcaagaagaaggtaaaacaggatctcttggaattaaagagcgttataaagctccaggcctggtggcgaggcactatgatacggagagaaattggtggtttcaagatgcctaaagacaaagttgatagcaaggattcaaaaggcaaaggtaaaggcaaggataagaggagaggcaagaagaagtga

SEQ ID NO: 7110 - DNA, 1647 bp, synthetic construct; identical to SEQ ID NO: 6537
  misc_feature 1..1647: note = Synthetic polypeptide
  source 1..1647: mol_type = other DNA

SEQ ID NO: 7111 - DNA, 70 bp, synthetic construct; identical to SEQ ID NO: 6538
  misc_feature 1..70: note = Synthetic polypeptide
  source 1..70: mol_type = other DNA

SEQ ID NO: 7112 - DNA, 432 bp, synthetic construct; identical to SEQ ID NO: 6539
  misc_feature 1..432: note = Synthetic polypeptide
  source 1..432: mol_type = other DNA

SEQ ID NO: 7113 - DNA, 1901 bp, synthetic construct
  misc_feature 1..1901: note = Synthetic polypeptide
  source 1..1901: mol_type = other DNA
ccgggcgcagtggctcatgcctgtaatcccagcactttgggaggccgagtgaggtgctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagcattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccagcacctattctgagtttgcgaaggatccgtccctctctgacagttccactgttgggcttcagcgagaactttcaaaggcttccaaatctgatgctacttctggaatcctcaattcaaccaacatccagtcctga

SEQ ID NO: 7114 - DNA, 1739 bp, synthetic construct
  misc_feature 1..1739: note = Synthetic polypeptide
  source 1..1739: mol_type = other DNA
ccgggcgcagtggctcatgcctgtaatcccagcactttgggaggccgagtgaggtgctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagcattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtgcgagaactttcaaaggcttccaaatctga

SEQ ID NO: 7115 - DNA, 1859 bp, synthetic construct
  misc_feature 1..1859: note = Synthetic polypeptide
  source 1..1859: mol_type = other DNA
ccgggcgcagtggctcatgcctgtaatcccagcactttgggaggccgagtgaggtgctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagcattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccagcacctattctgagtttgcgcgagaactttcaaaggcttccaaatctgatgctacttctggaatcctcaattcaaccaacatccagtcctga

SEQ ID NO: 7116 - DNA, 1616 bp, synthetic construct
  misc_feature 1..1616: note = Synthetic polypeptide
  source 1..1616: mol_type = other DNA
ccgggcgcagtggctcatgcctgtaatcccagcactttgggaggccgagtgaggtgctggcggaggagtccatagtatgtctgcagaaagccctaaatcaccttcgggaaatatgggagctaattgggattccagaggaccagcggttacaaagaactgaggtggtaaagaagcatatcaaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagcattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtgcgagaactttcaaaggcttccaaatctga

SEQ ID NO: 7117 - DNA, 501 bp, synthetic construct
  misc_feature 1..501: note = Synthetic polypeptide
  source 1..501: mol_type = other DNA
ccgggcgcagtggctcatgcctgtaatcccagcactttgggaggccgagtgaggtgctggcggaggagtccatagtatgtctgcagaaagccctaaatcaccttcgggaaatatgggagctaattgggattccagaggaccagcggttacaaagaactgaggtggtaaagaagcatatcaaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagcattagaccacaccccagacacaagct

SEQ ID NO: 7118 - DNA, 369 bp, synthetic construct
  misc_feature 1..369: note = Synthetic polypeptide
  source 1..369: mol_type = other DNA
ccgggcgcagtggctcatgcctgtaatcccagcactttgggaggccgagtgaggtgctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcaaaagcatatccgtctgtcagaaagagctgaacactctgtgcagcgagttacatgttgagccatttcaggaattcacttggaatcttataacagtggtacgttgtcttattcaggaagaaggagagacgacca

SEQ ID NO: 7119 - DNA, 1946 bp, synthetic construct
  misc_feature 1..1946: note = Synthetic polypeptide
  source 1..1946: mol_type = other DNA
tgtgcagaaaagagttaacatggcaaatctgagactgctaattatcagaaagcctggcttgaaaggctggtcctcggctggcctctgggaacttggctgataaaccctgataataacctttccctatatgagaagagtggctcagtgtgcctaaactatttgtacaagttgtgtggttatgctgaacacctggtttccttattggagtctgaaattttggtatgtactaggcagcgggtgcctatgtgaccagcccgcagtaatagcctttgacattgagtctccaatgagctttcgtggtagacaacacaacacattgcacgtgttgtcagcactcgctactgtgggaaggaagtgtgtcctgagtcactgcatacctggtttcttccaaacttctctccgtgtgtcttttccctgtgctgcaactcaatgaaaaactgattgcttatcaacgagaattccttgctttgaaagaacgtcttcgaatagctgaacacagaatctcacagcgctcttctgaattaaatacgattgtgcaacagttcaagcgtgtaggagcagaaacaaatggaagtaaggatgcgttgaataagttttcagataataccctaaagctgttaaaggagttaacaagcaaaaaatctcttcaagtgccaagtatttattatcatttgcctcatttattgaaaaatgaaggaagtcttcaacctgctgtacagattggcaacggaagaacaggagtttcaatagtcatgggcattcccacagtgaagagagaagttaaatcttacctcatagaaactcttcattcccttattgataacctgtatcctgaagagaagttggactgtgttatagtagtcttcataggagagacagatattgattatgtacatggtgttgtagccaacctggagaaagaattttctaaagaaatcagttctggcttggtggaagtcatatcaccccctgaaagctattatcctgacttgacaaacctaaaggagacatttggagactccaaagaaagagtaagatggagaacaaagcaaaacctagattactgttttctaatgatgtatgctcaagaaaagggcatatattacattcagcttgaagatgatattattgtcaaacaaaattattttaataccataaaaaattttgcacttcaactttcttctgaggaatggatgattctagagttttcccagctgggcttcattggtaaaatgtttcaagcgccggatcttactctgattgtagaattcatattcatgttttacaaggagaaacccattgattggctcctggaccatattctctgggtgaaagtctgcaaccctgaaaaagatgcaaaacattgtgatagacagaaagcaaatctgcgaattcgcttcagaccttcccttttccaacatgttggtctgcactcatcactatcaggaaaaatccaaaaactcacggataaagattatatgaaaccattacttcttaaaatccatgtaaacccacctgcggaggtatctacttccttgaaggtctaccaagggcatacgctggagaaaacttacatgggagaggatttcttctgggctatcacaccgatagctggagactacatcttgtttaaatttgataaaccagtcaatgtagaaagttatttgttccatagcggcaaccaagaacatcctggagatattctgctaaacacaactgtggaagttttgccttttaagagtgaaggtttggaaataagcaaagaaaccaaagacaaacgattagaagatggctatttcagaataggaaaatttgagaatggtgttgcagaaggaatggtggatccaagtctcaatcccatttcagcctttcgactttcagttattcagaattctgctgtttgggccattcttaatgagattcatattaaaaaagccaccaactga

SEQ ID NO: 7120 - DNA, 112 bp, synthetic construct
  misc_feature 1..112: note = Synthetic polypeptide
  source 1..112: mol_type = other DNA
gctggacgtgttggcttatgcttgtaatcctgacactttgggaggccgagtggccgcaagaggaagaggacgtggaatgggacgtggaaacatctttcaaaagcgaagataa

SEQ ID NO: 7121 - DNA, 1905 bp, synthetic construct
  misc_feature 1..1905: note = Synthetic polypeptide
  source 1..1905: mol_type = other DNA
ggccaggtgtggtggctcacgcctgtaatcccagcactttggtaggccaaggtgggtggatcacgaggtcaggagatccagaccatcctggctaacatggtgaaacctcacctctactagaaatacaaaaaatcagccgggcgtggtggtgggtgcctgtagtcccagctactccggaggctgaggcaagagaatggcgtgaacccgcgaggcggagcttgtgagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagattcaactagcctatcaaaaatcttggatacagttcattcttgtgaaagagcaagggaacttcaaaaagatcactgtgaacaacgtacaggaaaaatggaacaaatgaaaaagaagttttgtgtactgaaaaagaaactgtcagaagcaaaagaaataaaatcacagttagagaaccaaaaagttaaatgggaacaagagctctgcagtgtgagattgactttaaaccaagaagaagagaagagaagaaatgccgatatattaaatgaaaaaattagggaagaattaggaagaatcgaagagcagcataggaaagagttagaagtgaaacaacaacttgaacaggctctcagaatacaagatatagaattgaagagtgtagaaagtaatttgaatcaggtttctcacactcatgaaaatgaaaattatctcttacatgaaaattgcatgttgaaaaaggaaattgccatgctaaaactggaaatagccacactgaaacaccaataccaggaaaaggaaaataaatactttgaggacattaagattttaaaagaaaagaatgctgaacttcagatgaccctaaaactgaaagaggaatcattaactaaaagggcatctcaatatagtgggcagcttaaagttctgatagctgagaacacaatgctcacttctaaattgaaggaaaaacaagacaaagaaatactagaggcagaaattgaatcacaccatcctagactggcttctgctgtacaagaccatgatcaaattgtgacatcaagaaaaagtcaagaacctgctttccacattgcaggagatgcttgtttgcaaagaaaaatgaatgttgatgtgagtagtacgatatataacaatgaggtgctccatcaaccactttctgaagctcaaaggaaatccaaaagcctaaaaattaatctcaattatgcaggagatgctctaagagaaaatacattggtttcagaacatgcacaaagagaccaacgtgaaacacagtgtcaaatgaaggaagctgaacacatgtatcaaaacgaacaagataatgtgaacaaacacactgaacagcaggagtctctagatcagaaattatttcaactacaaagcaaaaatatgtggcttcaacagcaattagttcatgcacataagaaagctgacaacaaaagcaagataacaattgatattcattttcttgagaggaaaatgcaacatcatctcctaaaagagaaaaatgaggagatatttaattacaataaccatttaaaaaaccgtatatatcaatatgaaaaagagaaagcagaaacagaaaactcatga

SEQ ID NO: 7122 - DNA, 873 bp, synthetic construct; identical to SEQ ID NO: 6614
  misc_feature 1..873: note = Synthetic polypeptide
  source 1..873: mol_type = other DNA

SEQ ID NO: 7123 - DNA, 207 bp, synthetic construct; identical to SEQ ID NO: 6615
  misc_feature 1..207: note = Synthetic polypeptide
  source 1..207: mol_type = other DNA

SEQ ID NO: 7124 - DNA, 566 bp, synthetic construct; identical to SEQ ID NO: 869
  misc_feature 1..566: note = Synthetic polypeptide
  source 1..566: mol_type = other DNA

SEQ ID NO: 7125 - DNA, 1905 bp, synthetic construct; identical to SEQ ID NO: 7121
  misc_feature 1..1905: note = Synthetic polypeptide
  source 1..1905: mol_type = other DNA

SEQ ID NO: 7126 - DNA, 68 bp, synthetic construct
  misc_feature 1..68: note = Synthetic polypeptide
  source 1..68: mol_type = other DNA
ggccaggcatggtggctcaagcctggaatcccagcactttgggatgctgagggcactgtgacctttga

SEQ ID NO: 7127 - DNA, 416 bp, synthetic construct
  misc_feature 1..416: note = Synthetic polypeptide
  source 1..416: mol_type = other DNA
ggccaggcatggtggctcaagcctggaatcccagcactttgggatgctgagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcata

SEQ ID NO: 7128 - DNA, 514 bp, synthetic construct
  misc_feature 1..514: note = Synthetic polypeptide
  source 1..514: mol_type = other DNA
ggccaggcatggtggctcaagcctggaatcccagcactttgggatgctgagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcac

SEQ ID NO: 7129 - DNA, 1743 bp, synthetic construct
  misc_feature 1..1743: note = Synthetic polypeptide
  source 1..1743: mol_type = other DNA
ggccaggcatggtggctcaagcctggaatcccagcactttgggatgctgagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatga

SEQ ID NO: 7130 - DNA, 1349 bp, synthetic construct
  misc_feature 1..1349: note = Synthetic polypeptide
  source 1..1349: mol_type = other DNA
ctgagcctgtttcctcacctggtaaatagattgtggcccagaagaaggtgacccgcccgctgctgctcaagtttggcaggaacgctggcaagtccaccatcacggtgatcgccgaggacatctcggggaacaacggctacgtggagctctccttccgggccaggaagctggacgacaaggacctcttcagcaagtccgaccccttcctggagctctacagggtcaacgacgaccagggcttgcagctggtgtacaggacggaggtggtgaagaacaacctgaacccggtgtgggaggccttcaaagtctctctgagttccctctgcagctgcgaggagacaaggcctctaaagtgcctggtctgggattacgactctcgaggaaagcacgacttcatcggagaattctctaccaccttcgaggagatgcagaaggcctttgaggaggggcaggcccagtgggactgtgtgaaccccaaatacaagcagaagagacgcagttataagaactcaggagtggtcgtcctggctgacctcaagttccacagggtgtactccttcctggactatatcatgggcggctgccagatccacttcaccgtggccattgacttcaccgcctccaatggagacccgcggaacagctgctccctgcactacatcaacccctaccagccgaacgagtacctgaaggcactggtgtccgtgggcgagatctgccaggactatgacagtgacaagaggttttccgctttggggtttggagcccggatccctcccaagtatgaggtgtcccatgactttgccatcaatttcaaccctgaggacgatgagtgtgaaggcatccagggcgtggtggaggcctaccagaactgcctgcccagggtccagctctacggccccaccaacgtggcgcccatcatctccaaggtggcacgcgtggcggcggccgaggagagcaccgggaaagcctctcaatactacatcctgctgatcctgacggacggcgtggtgaccgacatggccgacacacgggaggccattgtgcgtgcctcacgcctgcccatgtccatcatcatcgtgggcgtgggcaacgccgacttcaccgacatgcaggtcctggacggcgacgacggcgtcctgcgctccccacggggtgagcccgcgctccgggacatcgtacagttcgtgcccttccgggagctcaagaacgcatcccctgcggcgctggccaagtgcgtgctggccgaggtcccgaagcaggtggtggagtactacagccacagaggcctgcccccgagaagcctgggtgtccctgccggagaggccagcccaggctgcacaccgtga

SEQ ID NO: 7131 - DNA, 3717 bp, synthetic construct
  misc_feature 1..3717: note = Synthetic polypeptide
  source 1..3717: mol_type = other DNA
ggacgggcgcgggggctgacgcctgtaatcccaacactttgggaggccgaggggtattccctcagcggatactacacccatccatttcaaggctatgagcacagacagctcaggtaccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcagaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccaaaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatag

SEQ ID NO: 7132 - DNA, 3636 bp, synthetic construct
  misc_feature 1..3636: note = Synthetic polypeptide
  source 1..3636: mol_type = other DNA
ggacgggcgcgggggctgacgcctgtaatcccaacactttgggaggccgaggggtattccctcagcggatactacacccatccatttcaaggctatgagcacagacagctcaggtaccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcagaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccaaaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagagctccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagta

SEQ ID NO: 7133 - DNA, 1164 bp, synthetic construct
  misc_feature 1..1164: note = Synthetic polypeptide
  source 1..1164: mol_type = other DNA
cttggcaggtggtgagctccccactgcaggctgtattcaggtgtggccggataactacgtggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatgatgccctgaagaatctctcgcacactcctgtctccaagtttgtcctggaccgaatatttgtctgtgacaagcacaagattcttttctgccagactcccaaagtgggcaacacccagtggaagaaagtgctgattgttctaaatggagcattttcttccattgaggagatccccgaaaacgtggtgcacgaccacgagaagaacggccttcctcggctctcttccttcagtgatgcagaaattcagaagcgattgaaaacatacttcaagttttttattgtaagagatcccttcgaaagacttatttctgcatttaaggataaatttgttcacaatccccggtttgagccttggtacaggcatgagattgctcctggcatcatcagaaaatacaggaggaaccggacagagacccgggggatccagtttgaagatttcgtgcgctacctcggcgatccgaaccacagatggctagaccttcagtttggggaccacatcattcactgggtgacgtatgtagagctctgtgctccctgtgagataatgtacagtgtgattggacaccacgagaccctggaggacgatgccccatacatcttaaaagaggctggcattgaccacctggtgtcatacccgactatccctccgggcattaccgtgtataacagaaccaaggtggagcactatttcctgggcatcagcaaacgagacatccgacgcctgtatgcccgtttcgaaggggactttaagctctttgggtaccagaaaccagactttttgctaaactaa

SEQ ID NO: 7134 - DNA, 376 bp, synthetic construct
  misc_feature 1..376: note = Synthetic polypeptide
  source 1..376: mol_type = other DNA
cttggcaggtggtgagctccccactgcaggctgtattcaggtgtggccggataactacgtggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatg

SEQ ID NO: 7135 - DNA, 956 bp, synthetic construct
  misc_feature 1..956: note = Synthetic polypeptide
  source 1..956: mol_type = other DNA
ccacactccttccccttaattctggtttgtcaagcctccacttagatgacatgtgaggaagccttctctgactcttcactcattgaagtctctgctgtattcatccagagctccctgtactttcccaacagtatcgctctttatattcatcgtgaatgtttaatttaactcttgttcactacaaagcctcccgaggagcccagacagctgcagccacagctccccgtatcaagaaatttgccatctatcgatgggacccagacaaggctggagacaaacctcatatgcagacttatgaagttgaccttaataaatgtggccccatggtattggatgctttaatcaagattaagaatgaagttgactctactttgaccttccgaagatcatgcagagaaggcatctgtggctcttgtgcaatgaacatcaatggaggcaacactctagcttgcacccgaaggattgacaccaacctcaataaggtctcaaaaatctaccctcttccacacatgtatgtgataaaggatcttgttcccgatttgagcaacttctatgcacagtacaaatccattgagccttatttgaagaagaaggatgaatctcaggaaggcaagcagcagtatctgcagtccatagaagagcgtgagaaactggacgggctctacgagtgcattctctgtgcctgctgtagcaccagctgccccagctactggtggaacggagacaaatatctggggcctgcagttcttatgcaggcctatcgctggatgattgactccagagatgacttcacagaggagcgcctggccaagctgcaggacccattctctctataccgctgccacaccatcatgaactgcacaaggacctgtcctaagggtctgaatccagggaaagctattgcagagatcaagaaaatgatggcaacctataaggagaagaaagcttcagtttaa

SEQ ID NO: 7136 - DNA, 386 bp, synthetic construct; identical to SEQ ID NO: 6552
  misc_feature 1..386: note = Synthetic polypeptide
  source 1..386: mol_type = other DNA

SEQ ID NO: 7137 - DNA, 1328 bp, synthetic construct; identical to SEQ ID NO: 783
  misc_feature 1..1328: note = Synthetic polypeptide
  source 1..1328: mol_type = other DNA

SEQ ID NO: 7138 - DNA, 1325 bp, synthetic construct; identical to SEQ ID NO: 784
  misc_feature 1..1325: note = Synthetic polypeptide
  source 1..1325: mol_type = other DNA

SEQ ID NO: 7139 - DNA, 2387 bp, synthetic construct
  misc_feature 1..2387: note = Synthetic polypeptide
  source 1..2387: mol_type = other DNA
atatttaaaaattgtatagtatttagcaacaaaaaggaatgaacaattgatgctgtacacacagcaaattatacaaacctcaaggacaacatactcagtgaagaaaattcagtcaccaagggatacatactgcatgattccattcctacaatatttgcaaaataacttccttgtagagatgtagaacagattagtggttgctagcagttaagaatgagaaagagagagatggatgtggctatggagacatgacacaagggagtcttatgggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcatctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataa

SEQ ID NO: 7140 - DNA, 1478 bp, synthetic construct
  misc_feature 1..1478: note = Synthetic polypeptide
  source 1..1478: mol_type = other DNA
atatttaaaaattgtatagtatttagcaacaaaaaggaatgaacaattgatgctgtacacacagcaaattatacaaacctcaaggacaacatactcagtgaagaaaattcagtcaccaagggatacatactgcatgattccattcctacaatatttgcaaaataacttccttgtagagatgtagaacagattagtggttgctagcagttaagaatgagaaagagagagatggatgtggctatggagacatgacacaagggagtcttatgggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggactctttggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcatctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataa

SEQ ID NO: 7141 - DNA, 2059 bp, synthetic construct
  misc_feature 1..2059: note = Synthetic polypeptide
  source 1..2059: mol_type = other DNA
ttttagagcacgtcgccaagaaagtgaaaagacagtccacataatggaagaatatatttgcaaatcatgtatcttataacacccatgaatctagcctatgtaaagaaccgttacaaattaataataaaaagaaaaataacccagtttgaaaatggacgaggatctcagcagacatttctccaaagaatgtatacaagtggctgacaatcacatgaaaaaatgctcagcatcctgttatcagagaaattcaatcaaaaacacaatataccacttcacatgtactaggatggctgtaataaaagatataataaaaaatgatcctaaagatgtggagaaattggaatcctcatctgtggctcctgggaatataaaatggtaccaccactttggtaaacagtctggcagtttctcaaagtgataatcatgtagttgtcatatgatccagcaatttgactcctaggtatataccgaagagagatgagaaaatgtgtccacaaaaaacttgcacccagatgttcatagcagcgttatagcaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctga

SEQ ID NO: 7142 - DNA, 1378 bp, synthetic construct
  misc_feature 1..1378: note = Synthetic polypeptide
  source 1..1378: mol_type = other DNA
aaattggtaccaggaatgaggtactgcctaaagatacctaaaaatgtggaagcaattttggaactgggtaatgggcagtggctggaacagtttggagggctcagaagaagataggaagatgtgggaaagtttggaacttcctagagacttgttgaatagttttgaccaaaattctgatagtgacatggacaatgaagtctaggctgaggtggtgtcagatggagatgaggaactttttgggaactggagcagaggtcactcttgttatatcttagcaaagagactggtggcattttgctcccaccctagaggtctgtggaattttgaacttgagaaagatgatttagggtatctggcagaagaaatttctaagcagcaaagcattcaagaagtgacctggcttttggtaaaagtgtatgcccatattcgttcacaaagaaaaaatcagaaattggaagttaaagggaagcagaccgtaaaagtttgaaaaatttgcagcctgaccatgcagtaaaaaagaaaaacctatcttctggcaataaattcaagctggctgcagatatttgcataagtaatgaggagcccaatgttaatggcaaagacaatgaggaaagtacctccagggcatgtcagagatcttcacagcagcccctcccatcgcaagcctggcagcctagtagggaaaaatggttttatgggtcaggccagggccctgctcctctgttcagccttgggacattgtaccctgcatcccagccactccagctccagccgtggctaaaaggggccaaggtacagctcaaactatggcttaagaggatgcaatccccaagtcttacagcttccacgtggtgttgggcctgctgctgtgcaaaagacgagagttcagctttgggagcctccatctagatttcagagaatgtatggagatgtctgaatgtccaagcagaaatctgctgcaggtcagagccctcaaggagaacctctgctacagcagtgcaggcttcaaggagacaacctggaagaaaggacagaagagtcactaccaatactccattctccagatgaaaaaatcccagattcattcgattccttgcctgggactgaagaagcactaatggaggagggtgacgaatttgagaaagcatctaaactaacaggacctggagaagcctccagtggagtaggacactcactgaaaaactacatggaagaagatgaatccttaaagcaattgcaggtagttcatcaaccatggatcttgccaagtgacacagaaagtgaaggagtggaagcagaacaagagaaacgttccgctgatcttcttctttgcgttccatgctcttcttgtcctacgctggtctactctggtttgtga

SEQ ID NO: 7143 - DNA, 1393 bp, synthetic construct
  misc_feature 1..1393: note = Synthetic polypeptide
  source 1..1393: mol_type = other DNA
aaattggtaccaggaatgaggtactgcctaaagatacctaaaaatgtggaagcaattttggaactgggtaatgggcagtggctggaacagtttggagggctcagaagaagataggaagatgtgggaaagtttggaacttcctagagacttgttgaatagttttgaccaaaattctgatagtgacatggacaatgaagtctaggctgaggtggtgtcagatggagatgaggaactttttgggaactggagcagaggtcactcttgttatatcttagcaaagagactggtggcattttgctcccaccctagaggtctgtggaattttgaacttgagaaagatgatttagggtatctggcagaagaaatttctaagcagcaaagcattcaagaagtgacctggcttttggtaaaagtgtatgcccatattcgttcacaaagaaaaaatcagaaattggaagttaaagggaagcagaccgtaaaagtttgaaaaatttgcagcctgaccatgcagtaaaaaagaaaaacctatcttctggcaataaattcaagctggctgcagatatttgcataagtaatgaggagcccaatgttaatggcaaagacaatgaggaaagtacctccagggcatgtcagagatcttcacagcagcccctcccatcgcaagcctggcagcctagtagggaaaaatggttttatgggtcaggccagggccctgctcctctgttcagccttgggacattgtaccctgcatcccagccactccagctccagccgtggctaaaaggggccaaggtacagctcaaactatggcttaagaggatgcaatccccaagtcttacagcttccacgtggtgttgggcctgctgctgtgcaaaagacgagagttcagctttgggagcctccatctagatttcagagaatgtatggagatgtctgaatgtccaagcagaaatctgctgcaggtcagagccctcaaggagaacctctgctacagcagtgcaggcttcaaggagacaacctggaagaaaggacagaagagtcactaccaatactccattctccagatgaaaaaatcccagattcattcgattccttgcctgggactgaagaagcactaatggaggagggtgacgaatttgagaaagcatctaaactaacaggacctggagaagcctccagtggagtaggacactcactgaaaaactacatggaagaagatgaatccttaaagcaattgcaggtagttcatcaaccatggatcttgccaagtgacacagaaagtgaaggagtggaagcagaacaagagaaacacctactaaatcagaatctctgtggctgggactctgaattctgcatttttcatactttggcttctttcctcatctataaataa

SEQ ID NO: 7144 - DNA, 207 bp, synthetic construct
  misc_feature 1..207: note = Synthetic polypeptide
  source 1..207: mol_type = other DNA
tgtgatttccacaggtgacagaaaccaggcagtgattcaactcgtatttgactttcacattctccagcaatgttcttcaatctgggaagggtagaaaattaaagaaaggtggtacctctaaatccaaaaactccaaatgtccaccagctccagtcacattggagatacagctgtggtttgctcctaagacccacccagcacacgtga

SEQ ID NO: 7145 - DNA, 661 bp, synthetic construct; identical to SEQ ID NO: 6609
  misc_feature 1..661: note = Synthetic polypeptide
  source 1..661: mol_type = other DNA

SEQ ID NO: 7146 - DNA, 829 bp, synthetic construct; identical to SEQ ID NO: 6610
  misc_feature 1..829: note = Synthetic polypeptide
  source 1..829: mol_type = other DNA

SEQ ID NO: 7147 - DNA, 889 bp, synthetic construct; identical to SEQ ID NO: 6611
  misc_feature 1..889: note = Synthetic polypeptide
  source 1..889: mol_type = other DNA

SEQ ID NO: 7148 - DNA, 851 bp, synthetic construct
  misc_feature 1..851: note = Synthetic polypeptide
  source 1..851: mol_type = other DNA
ggccgggtgtggtggctcacgcctgtagtcccagcactttgggaggccaagatgggtggatcacttgaggtggcacgcctgggcaacatggcgaaacaccatctctactaaaaatgcaaaaattagccaggtggcacgcgcctgtggtcccagctactcaggagactgaagcatgagaatcgcttgaacccaggaggcagaggttgcagtgagccgagatcacaccactgcactccagcctgggcaacagaggacatgttgtcttaacagattttgggctttgtaaagaaggaattgctatttctgacaccactaccacattttgtgggacaccagagtatcttgcacctgaagtaattagaaaacagccctatgacaatactgtagattggtggtgccttggggctgttctgtatgaaatgctgtatggattgcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtga

SEQ ID NO: 7149 - DNA, 755 bp, synthetic construct
  misc_feature 1..755: note = Synthetic polypeptide
  source 1..755: mol_type = other DNA
ggccgggtgtggtggctcacgcctgtagtcccagcactttgggaggccaagatgggtggatcacttgaggtggcacgcctgggcaacatggcgaaacaccatctctactaaaaatgcaaaaattagccaggtggcacgcgcctgtggtcccagctactcaggagactgaagcatgagaatcgcttgaacccaggaggcagaggttgcagtgagccgagatcacaccactgcactccagcctgggcaacagaggacatgttgtcttaacagattttgggctttgtaaagaaggaattgctatttctgacaccactaccacattttgtgggacaccagagcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtga

SEQ ID NO: 7150 - DNA, 1422 bp, synthetic construct
  misc_feature 1..1422: note = Synthetic polypeptide
  source 1..1422: mol_type = other DNA
ggctgggtgcaatggctcacacctgtaatcccagcactttgggaggccaaggcgggcagatcacttgaggatgatggaccaacagcaagagacctgctagtacaatatgctacagggaagaaaagttccaaaaacaagaaaaagttggaaaaggcaatgaaagtgctcaagaaacaaaaaaagaagaaaaaaccagaggtgtttaacttttcagccattcacttgattcatgatccccaagattttgcggaaaaactactaaagcagcttgagtgctgtaaggagaggtttgaagtgaagatgatgctcatgaaccttatctccagattggtgggaattcatgagcttttcctcttcaatttctatccctttttgcaaaggtttctgcagccccaccaaagagaagtaaccaagatccttctgtttgctgcacaagcatctcatcacctagtacccccagagattattcaatcattgcttatgactgtggcaaacaattttgttaccgacaagaactctggagaagtcatgacagtaggaatcaatgctataaaggagataacagctcgatgtcctctggccatgactgaagaacttctccaagacctggctcagtataaaacacacaaggataagaatgtaatgatgtctgctagaactttgattcacctcttccgaacactgaatcctcagatgctgcagaagaaattccggggtaagcctacagaggcctccatagaagcaagagtacaagaatatggagaattagatgctaaagattacattccaggagcagaagttctggaagttgagaaagaagagaatgctgaaaatgatgaagatggatgggaaagtaccagtctcagtgaggaggaggatgctgatggtgaatggattgatgtgcaacactcttccgatgaagaacagcaagaaatctccaagaagctgaacagcatgcccatggaggagcggaaggccaaagctgcagccatcagcactagccgagttttaactcaggaagacttccagaaaatccgcatggcccaaatgagaaaagaacttgatgctgcccccgggaaatcccagaagaggaaatacattgaaatagacagtgatgaagagcccaggggtgaattactttctcttcgggacattgaacgccttcataaaaagccaaagtctgacaaagagacaagactagcaactgcaatggctggaaagacagaccgaaaagaatttgtgaggaagaaaaccaaaacaaatccattttccagttcgacaaataaagagaagaaaaaacagaagaactttatgatgatgcggtatagccagaatgtccggtcaaaaaataagcgttccttccgagaaaaacagttggcactacgagatgcacttttgaaaaagagaaaaagaatgaagtaa

SEQ ID NO: 7151 - DNA, 892 bp, synthetic construct
  misc_feature 1..892: note = Synthetic polypeptide
  source 1..892: mol_type = other DNA
cagggcacctgcctgctggtttctgctgagcaggacaccagctgtgggactttaggcaggctgaggccccactctctctcagttttctgacctatataaactgctggagattcttggtgccaccattgagaactccaggattgtcctgcagatcgacaatgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctga

SEQ ID NO: 7152 - DNA, 371 bp, synthetic construct
  misc_feature 1..371: note = Synthetic polypeptide
  source 1..371: mol_type = other DNA
cagggcacctgcctgctggtttctgctgagcaggacaccagctgtgggactttaggcaggctgaggccccactctctctcagttttctgacctatataaactgctggagattcttggtgccaccattgagaactccaggattgtcctgcagatcgacaatgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggcc

SEQ ID NO: 7153 - DNA, 119 bp, synthetic construct; identical to SEQ ID NO: 6582
  misc_feature 1..119: note = Synthetic polypeptide
  source 1..119: mol_type = other DNA

SEQ ID NO: 7154 - DNA, 460 bp, synthetic construct
  misc_feature 1..460: note = Synthetic polypeptide
  source 1..460: mol_type = other DNA
gggaagaaacagacctatgtcttgttctaattttaccattcattagtggtctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccataatggtgggtcgccccggatcccgttcagcaccttccagtttctctacacgtatattgccaaagtggatggggagatctctgcatcacatgtcagcaggatgctaaactacatggaacaggaagtaattggccctgatggtataatcacagtgaatgactttacccaaaaccccagggttcagctggagtaa

SEQ ID NO: 7155 - DNA, 210 bp, synthetic construct
  misc_feature 1..210: note = Synthetic polypeptide
  source 1..210: mol_type = other DNA
gggaagaaacagacctatgtcttgttctaattttaccattcattagtggtctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctct

SEQ ID NO: 7156 - DNA, 170 bp, synthetic construct
  misc_feature 1..170: note = Synthetic polypeptide
  source 1..170: mol_type = other DNA
gggaagaaacagacctatgtcttgttctaattttaccattcattagtggtctcaggttgctggcagactgatcatccgtgcagaggagctggcccagatgtggaaagtggtgaatctcccaacagatctgtttaatagtgtgatgaatgtgggtcgcttcacggaggaga

SEQ ID NO: 7157 - DNA, 520 bp, synthetic construct
  misc_feature 1..520: note = Synthetic polypeptide
  source 1..520: mol_type = other DNA
cgtcctccgactgctgctccatcgccgccagccccggcgtctgcctctgtccgctctttctcgcgcccctttctggtctgcagcagatctgtgggctctactttccaatacactcagaaagccccaccgtttcccaccgccttgggttcctgctcccacgctcgcgcccttctctgcgttcacagcggcggccacggtgatttccttaaagctgaggcacgcaggtccgtgctgtgcgcagaaaccttcggctcttctccagctcacgcagacgaaaagccggagttctcccagggcctaccaggtaacaaatcggaagtacccaaaactgaaagaagtggatgatgtgcttggtggagcagctgcctgggagaatgttgactctactgcagagtcgtgtcccaaatgcgaacatcctcgtgcttacttcatgcagcttcagacccgctctgcagatgagccgatgaccaccttctacaagtgctgcaatgctcagtgtggacaccgctggagggattag

SEQ ID NO: 7158 - DNA, 604 bp, synthetic construct
  misc_feature 1..604: note = Synthetic polypeptide
  source 1..604: mol_type = other DNA
ggctgtgcatggtgtctcacgcccataatcccagcactttgggagaccaagatccaaaaagttggcagctcttgcagaagccttaaaggaagtctcccttacaaaggcccagctggggttagaactggaagaactagaagcagcagcactgcttgtccaggaggaagaaactgcattaaaagcagcccattcagtttctgggcagcagacactttgctccagctctgaggcaagtgattcggaggactcagacagcagcgtgtcatctggaaacgaagactcaggctcagattcagaacaagatgaactcaaagatagtccatctgagacagtcagttctttgcaaggtccctttcttgaagaaagcagtgcctttcttattgttgatggtggagtacgcagaaacacagccatccaggagtctgatgccagtcagggaaagccacttgcctcttcctggcctcttggagtgtctgggcctctgatagaggagcttggggaacaactgaagactacagttcaggtttctgaacccaagggcaccactgctgtaaaccgcagcaatattcaggagagagacggctgtcagacaccaaataattga

SEQ ID NO: 7159 - DNA, 774 bp, synthetic construct
  misc_feature 1..774: note = Synthetic polypeptide
  source 1..774: mol_type = other DNA
ttccactgtgctccacgaggctcagaccataacctgggatatttttcccacttttatatcatctcagtgctgtggaatggcttcctgctttggtgccttactcaatctctgttcctgggagcaccttttccaagctggcttcatggtttgctcagaattctcggggcggcacagttccagggaggggagctggcactgtctgcattcttagtgctagtatttctgtggctgcacagcttacgaagactcttcgagtgcctctacgtcagtgtcttctccaatgtcatgattcacgtcgtgcagtactgttttggacttgtctattatgtccttgttggcctaactgtgctgagccaagtgccaatggatggcaggaatgcctacataacagggaaaaatctattgatgcaagcacggtggttccatattcttgggatgatgatgttcatctggtcatctgcccatcagtataagtgccatgttattctcggcaatctcaggaaaaataaagcaggagtggtcattcactgtaaccacaggatcccatttggagactggtttgaatatgtttcttcccctaactacttagcagagctgatgatctacgtttccatggccgtcacctttgggttccacaacttaacttggtggctagtggtgacaaatgtcttctttaatcaggccctgtctgcctttctcagccaccaattctacaaaagcaaatttgtctcttacccgaagcataggaaagctttcctaccatttttgttttaa

SEQ ID NO: 7160 - DNA, 441 bp, synthetic construct
  misc_feature 1..441: note = Synthetic polypeptide
  source 1..441: mol_type = other DNA
ttccactgtgctccacgaggctcagaccataacctgggatatttttcccacttttatatcatctcagtgctgtggaatggcttcctgctttggtgccttactcaatctctgttcctgggagcaccttttccaagctggcttcatggtttgctcagaattctcggggcggcacagttccagggagtggtcattcactgtaaccacaggatcccatttggagactggtttgaatatgtttcttcccctaactacttagcagagctgatgatctacgtttccatggccgtcacctttgggttccacaacttaacttggtggctagtggtgacaaatgtcttctttaatcaggccctgtctgcctttctcagccaccaattctacaaaagcaaatttgtctcttacccgaagcataggaaagctttcctaccatttttgttttaa

SEQ ID NO: 7161 - DNA, 718 bp, synthetic construct; identical to SEQ ID NO: 821
  misc_feature 1..718: note = Synthetic polypeptide
  source 1..718: mol_type = other DNA

SEQ ID NO: 7162 - DNA, 1083 bp, synthetic construct
  misc_feature 1..1083: note = Synthetic polypeptide
  source 1..1083: mol_type = other DNA
caaagaaatggaaagatggtgaaacaacctggaaaccataccttatcatgaacagcggaagtatcttgaaagtgtggccctgagaagaaaaaaactgaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggaagcacgaatgtgggtgaccagcttcccactgggcagctgtcagtggtgccttggcgacggactggggtgaaatataccaacaatgaggcctattttgatgtgattgaagagattgatgcaattattgataaatcaggctccacaattactgctgagatccagggggtgattgatgcctgtgtcaagctgactggcatgccagaccttacactttccttcatgaaccctaggttgttggatgatgtcagcttccatccttgtgttcgtttcaaacgctgggaatctgagcgcatcctctccttcatccctcctgatggaaacttccgcctgctgtcttaccatgtcagtgcacagaatctggttgcaatcccagtgtatgtcaaacataacatcagtttccgggacagtagttcccttggacgctttgaaataacggtgggacccaagcagacgatggggaagaccattgagggagtgactgtcaccagccagatgcccaagggggtcctgaacatgagccttactccatcacaggggacacacacattcgacccagtcacaaagatgctgtcttgggatgtaggaaaaataaatccacaaaagctaccaagtttgaaggggaccatgagtcttcaggctggagcttccaaaccagatgaaaaccccacaattaacctgcagtttaagatccagcagctggccatttctggactcaaggtgaatcgtctggatatgtatggagaaaagtacaaaccctttaagggcataaaatacatgaccaaagctgggaagttccaagttcgaacctga

SEQ ID NO: 7163 - DNA, 648 bp, synthetic construct
  misc_feature 1..648: note = Synthetic polypeptide
  source 1..648: mol_type = other DNA
caaagaaatggaaagatggtgaaacaacctggaaaccataccttatcatgaacagcggaagtatcttgaaagtgtggccctgagaagaaaaaaactgaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggaagcacgaatgtgggtgaccagcttcccactgggcagctgtcagtggtgccttggcgacggactggggtgaaatataccaacaatgaggcctattttgatgtgattgaagagattgatgcaattattgataaatcaggctccacaattactgctgagatccagggggtgattgatgcctgtgtcaagctgactggcatgccagaccttacactttccttcatgaaccctaggttgttggatgatgtcagcttccatccttgtgttcgtttcaaacgctgggaatctgagcgcatcctctccttcatccctcctgatggaaacttccgcctgctgtcttaccatgtcagtgcacagaaatgctgtcttgggatgtag

SEQ ID NO: 7164 - DNA, 244 bp, synthetic construct
  misc_feature 1..244: note = Synthetic polypeptide
  source 1..244: mol_type = other DNA
caaagaaatggaaagatggtgaaacaacctggaaaccataccttatcatgaacagcggaagtatcttgaaagtgtggccctgagaagaaaaaaactgaggattattttggagtctgttcagagccagtgatcaaagacaatgtagttgtggtttatgaggtattggaagagatgcttgacaatggttttccattggctaccgagtcgaacattcttaaagaactcataaagcctcctaccatcc

SEQ ID NO: 7165 - DNA, 633 bp, synthetic construct
  misc_feature 1..633: note = Synthetic polypeptide
  source 1..633: mol_type = other DNA
caaagaaatggaaagatggtgaaacaacctggaaaccataccttatcatgaacagcggaagtatcttgaaagtgtggccctgagaagaaaaaaactgaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggaagcacgaatgtgggtgaccagcttcccactgggcagctgtcagtggtgccttggcgacggactggggtgaaatataccaacaatgaggcctattttgatgtgattgaagagattgatgcaattattgataaatcaggctccacaattactgctgagatccagggggtgattgatgcctgtgtcaagctgactggcatgccagaccttacactttccttcatgaaccctaggttgttggatgatgtcagcttccatccttgtgttcgtttcaaacgctgggaatctgagcgcatcctctccttcatccctcctgatggaaacttccgcctgctgtcttaccatgtcagtgcacagaagtaa

SEQ ID NO: 7166 - DNA, 495 bp, synthetic construct
  misc_feature 1..495: note = Synthetic polypeptide
  source 1..495: mol_type = other DNA
caaagaaatggaaagatggtgaaacaacctggaaaccataccttatcatgaacagcggaagtatcttgaaagtgtggccctgagaagaaaaaaactgaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggctccacaattactgctgagatccagggggtgattgatgcctgtgtcaagctgactggcatgccagaccttacactttccttcatgaaccctaggttgttggatgatgtcagcttccatccttgtgttcgtttcaaacgctgggaatctgagcgcatcctctccttcatccctcctgatggaaacttccgcctgctgtcttaccatgtcagtgcacagaagtaa

SEQ ID NO: 7167 - DNA, 406 bp, synthetic construct
  misc_feature 1..406: note = Synthetic polypeptide
  source 1..406: mol_type = other DNA
cctgccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggc

SEQ ID NO: 7168 - DNA, 1183 bp, synthetic construct
  misc_feature 1..1183: note = Synthetic polypeptide
  source 1..1183: mol_type = other DNA
cctgccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatga

SEQ ID NO: 7169 - DNA, 3701 bp, synthetic construct; identical to SEQ ID NO: 6659
  misc_feature 1..3701: note = Synthetic polypeptide
  source 1..3701: mol_type = other DNA

SEQ ID NO: 7170 - DNA, 3527 bp, synthetic construct; identical to SEQ ID NO: 6660
  misc_feature 1..3527: note = Synthetic polypeptide
  source 1..3527: mol_type = other DNA

SEQ ID NO: 7171 - DNA, 457 bp, synthetic construct; identical to SEQ ID NO: 6661
  misc_feature 1..457: note = Synthetic polypeptide
  source 1..457: mol_type = other DNA

SEQ ID NO: 7172 - DNA, 359 bp, synthetic construct; identical to SEQ ID NO: 6662
  misc_feature 1..359: note = Synthetic polypeptide
  source 1..359: mol_type = other DNA

SEQ ID NO: 7173 - DNA, 588 bp, synthetic construct; identical to SEQ ID NO: 6663
  misc_feature 1..588: note = Synthetic polypeptide
  source 1..588: mol_type = other DNA

SEQ ID NO: 7174 - DNA, 846 bp, synthetic construct
  misc_feature 1..846: note = Synthetic polypeptide
  source 1..846: mol_type = other DNA
ctctctctgcctcagttccctcatctataaaatgggagtgttgggaggtttaaagaatacatgcgagtcacttatcgtggtctctggcacccagtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtatttcagagacttacccatccctgtcatcacatatgatacctattccaaatttatagatgcagcaaaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaa

SEQ ID NO: 7175 - DNA, 506 bp, synthetic construct
  misc_feature 1..506: note = Synthetic polypeptide
  source 1..506: mol_type = other DNA
ctctctctgcctcagttccctcatctataaaatgggagtgttgggaggtttaaagaatacatgcgagtcacttatcgtggtctctggcacccagtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtattt

SEQ ID NO: 7176 - DNA, 672 bp, synthetic construct
  misc_feature 1..672: note = Synthetic polypeptide
  source 1..672: mol_type = other DNA
ctctctctgcctcagttccctcatctataaaatgggagtgttgggaggtttaaagaatacatgcgagtcacttatcgtggtctctggcacccagtccacacgttccgaggcccacactggtgtgaatattgtgccaatttcatgtgggggctcatcgcccaaggggtccggtgctcaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtatttcagagacttacccatccctgtcatcacatatgatacctattccaaatttatagatgcagcaaaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaa

SEQ ID NO: 7177 - DNA, 708 bp, synthetic construct
  misc_feature 1..708: note = Synthetic polypeptide
  source 1..708: mol_type = other DNA
ctctctctgcctcagttccctcatctataaaatgggagtgttgggaggtttaaagaatacatgcgagtcacttatcgtggtctctggcacccagtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaa

SEQ ID NO: 7178 - DNA, 4960 bp, synthetic construct
  misc_feature 1..4960: note = Synthetic polypeptide
  source 1..4960: mol_type = other DNA
aaatctaattccattattttccttgttaaaatccttaagtagctcccttcgcctgtagaataaactcaggattcttactgagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtaatctctctctgtaa

SEQ ID NO: 7179 - DNA, 5068 bp, synthetic construct
  misc_feature 1..5068: note = Synthetic polypeptide
  source 1..5068: mol_type = other DNA
aaatctaattccattattttccttgttaaaatccttaagtagctcccttcgcctgtagaataaactcaggattcttactgagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtga

SEQ ID NO: 7180 - DNA, 407 bp, synthetic construct
  misc_feature 1..407: note = Synthetic polypeptide
  source 1..407: mol_type = other DNA
aaatctaattccattattttccttgttaaaatccttaagtagctcccttcgcctgtagaataaactcaggattcttactgagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaaggtataaaagaatctgggaaaactcttcagatttttaacattgaaatgaaaagtaaaatgaaggctcataccatgactgatgatgtcaccttttggaaatggatctctttgaatacgg

SEQ ID NO: 7181 - DNA, 1879 bp, synthetic construct
  misc_feature 1..1879: note = Synthetic polypeptide
  source 1..1879: mol_type = other DNA
aaatctaattccattattttccttgttaaaatccttaagtagctcccttcgcctgtagaataaactcaggattcttactgagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtga

SEQ ID NO: 7182 - DNA, 334 bp, synthetic construct
  misc_feature 1..334: note = Synthetic polypeptide
  source 1..334: mol_type = other DNA
aaatctaattccattattttccttgttaaaatccttaagtagctcccttcgcctgtagaataaactcaggattcttactgagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagcaaaatcgtgtggtgggagctatgcagctatattctgtagatag

SEQ ID NO: 7183 - DNA, 3133 bp, synthetic construct
  misc_feature 1..3133: note = Synthetic polypeptide
  source 1..3133: mol_type = other DNA
ggaagaaaggcgaaggttgaaaaatgcaataattatccagtcatttattcgaggctatagagacagaaaacagcaatattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttgatatggctgtatcagaacttaattaaacacagctctctgtttgtcaagcagttggatggatctgagagacttacatgcttatttcagataaaaagattgatgagcctctgttgcaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatgggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggcaacaagtttttacagccttcacagaggagtttctggcagcaccttttacagatcagatttttcatttcatcattccggcgcttgcagatgcgcagaccgttttcccttacgagccctttctgaatgcactgttgttaatagagagtagatgttcaagaaagagtggtggagcaccctggcttttctatttcgttttaactgttggcgaaaattatttgggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcaggcttctctacagtttagcctttaatgccaggtttctgagacatctttggtttctaatatcttccatgtcaacacggatgatcacagggtctatggtaccgttgcttcaggtgatatccaggggttctcctatgtcttttgaagattctagtcgaatcatcccactcttttatctttttagctccttgtttagtcattcactaatttccatacatgataacgaattcttcggtgatcccatagaagttgtaggtcaaagacaatcatcaatgatgccttttactttagaagagctgataatgttgtctcgatgccttcgagatgcatgcctggggatcatcaagttggcttatccagaaaccaagccagaagttcgagaagaatatattacagcatttcagagtattggagttactactagctctgaaatgcaacaatgcatacagatggaacagaaaagatggattcagttatttaaggttatcaccaatctagtgaaaatgttgaagtccagagacacgaggagaaatttttgtcctccaaaccactggctgtcagaacaagaagatattaaagcagataaggtcactcagctctatgtgccagcatccagacatgtgtggaggttccggcggatggggaggataggcccgctgcagtccaccctggacgtgggtttggagtccccgccgctgtctgtgtctgaggaaagacagcttgctgtcctgacagagttgccttttgtggttccatttgaggaacgagtaaagatctttcagaggttgatttatgcagataagcaagaagttcaaggagatggtccatttctggatggaattaatgtcacaataagaagaaattacatttatgaagatgcttatgacaaactttctccagaaaatgagcctgatttgaaaaagcggatccgtgtgcacttgctcaatgcccatggcctggatgaagctggcattgatggtggtggtattttcagagagtttttaaatgaactactgaagtcaggatttaaccccaaccaggggttctttaagactactaatgaagggcttctgtaccccaacccggctgctcagatgcttgtgggagattcttttgccagacattactacttcctaggcagaatgcttggaaaggctctctatgagaacatgctggtggagctgccctttgcaggcttctttctttccaagttgcttggaaccagtgccgacgtggacattcaccacctcgcctccctagaccctgaggtgtataagaatttgctctttctgaagagctacgaagacgatgtggaggagcttgggctgaacttcactgtggtgaacaatgacctgggagaggcgcaggtagttgaactaaaattcggtgggaaagacatccctgtcaccagcgccaaccggattgcgtacatccacttggtggcagactacaggctgaacaggcagatccgccagcactgcctggctttccgccagggccttgccaatgtcgtcagcctcgagtggctccgaatgtttgatcagcaagaaattcaggtattaatttctggtgcacaagttcccataagcctagaggacctaaaatcctttacaaactattcaggaggctattctgcagaccatcctgttattaaggtcttctggagagttgtggaagggttcactgatgaagaaaagcgcaaactgctgaagtttgtaacaagctgctctcgaccccctctcttggggtttaaggagttgtatcccgcattttgtattcacaacggaggctccgaccttgagcggctccccacagccagcacctgcatgaacctgctgaagctccccgagttctatgacgagacacttttgcgaagtaaacttctctatgcgattgaatgtgccgctggctttgagctgagctga

SEQ ID NO: 7184 - DNA, 97 bp, synthetic construct
  misc_feature 1..97: note = Synthetic polypeptide
  source 1..97: mol_type = other DNA
gagtgagagaggagagagggagaagagagcgcgagagagggggggctatttcctaggggcgccgatcaagaatacagtgcatttcgagtagggatgg

SEQ ID NO: 7185 - DNA, 326 bp, synthetic construct
  misc_feature 1..326: note = Synthetic polypeptide
  source 1..326: mol_type = other DNA
gagtgagagaggagagagggagaagagagcgcgagagagggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgt

SEQ ID NO: 7186 - DNA, 2604 bp, synthetic construct
  misc_feature 1..2604: note = Synthetic polypeptide
  source 1..2604: mol_type = other DNA
gagtgagagaggagagagggagaagagagcgcgagagagggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggcttatcaacactgcaagctgtgctggattctgctgctgaaaagaaatggcaagtgactgctatcaatgtgggaaacattaacaatgacaagaaagatgagatgtaccgatcactttttcaagatctggagttaaaaaaggaacggcgtgtaattctggactgtgaaagggataaagtaaacgacattgtagaccaggttattaccattggaaaacatgttaaagggtaccactacatcattgcaaatctgggatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaagtatacttctgctctgacctatgatgccgttcaagtgatgactgaagccttccgcaacctaaggaagcaaagaattgaaatctcccgaagggggaatgcaggagactgtctggcaaacccagcagtgccctggggacaaggtgtagaaatagaaagggccctcaaacaggttcaggttgaaggtctctcaggaaatataaagtttgaccagaatggaaaaagaataaactatacaattaacatcatggagctcaaaactaatgggccccggaagattggctactggagtgaagtggacaaaatggttgttacccttactgagctcccttctggaaatgacacctctgggcttgagaataagactgttgttgtcaccacaattttggaatctccgtatgttatgatgaagaaaaatcatgaaatgcttgaaggcaatgagcgctatgagggctactgtgttgacctggctgcagaaatcgccaaacattgtgggttcaagtacaagttgacaattgttggtgatggcaagtatggggccagggatgcagacacgaaaatttggaatgggatggttggagaacttgtatatgggaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcagcaaggatgcgatatttcgccaagatccctctctgggcgcattgttggaggtgtgtggtggttctttaccctgatcataatctcctcctacacggctaacttagctgccttcctgactgtagagaggatggtgtctcccatcgaaagtgctgaggatctttctaagcaaacagaaattgcttatggaacattagactctggctccactaaagagtttttcaggagatctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaagaaccccagtaaatcttgcagtattgaaactcagtgagcaaggcgtcttagacaagctgaaaaacaaatggtggtacgataaaggtgaatgtggagccaaggactctggaagtaaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttag

SEQ ID NO: 7187 - DNA, 2604 bp, synthetic construct
  misc_feature 1..2604: note = Synthetic polypeptide
  source 1..2604: mol_type = other DNA
gagtgagagaggagagagggagaagagagcgcgagagagggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggcttatcaacactgcaagctgtgctggattctgctgctgaaaagaaatggcaagtgactgctatcaatgtgggaaacattaacaatgacaagaaagatgagatgtaccgatcactttttcaagatctggagttaaaaaaggaacggcgtgtaattctggactgtgaaagggataaagtaaacgacattgtagaccaggttattaccattggaaaacatgttaaagggtaccactacatcattgcaaatctgggatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaagtatacttctgctctgacctatgatgccgttcaagtgatgactgaagccttccgcaacctaaggaagcaaagaattgaaatctcccgaagggggaatgcaggagactgtctggcaaacccagcagtgccctggggacaaggtgtagaaatagaaagggccctcaaacaggttcaggttgaaggtctctcaggaaatataaagtttgaccagaatggaaaaagaataaactatacaattaacatcatggagctcaaaactaatgggccccggaagattggctactggagtgaagtggacaaaatggttgttacccttactgagctcccttctggaaatgacacctctgggcttgagaataagactgttgttgtcaccacaattttggaatctccgtatgttatgatgaagaaaaatcatgaaatgcttgaaggcaatgagcgctatgagggctactgtgttgacctggctgcagaaatcgccaaacattgtgggttcaagtacaagttgacaattgttggtgatggcaagtatggggccagggatgcagacacgaaaatttggaatgggatggttggagaacttgtatatgggaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcagcaaggatgcgatatttcgccaagatccctctctgggcgcattgttggaggtgtgtggtggttctttaccctgatcataatctcctcctacacggctaacttagctgccttcctgactgtagagaggatggtgtctcccatcgaaagtgctgaggatctttctaagcaaacagaaattgcttatggaacattagactctggctccactaaagagtttttcaggagatctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaagaaatgcggttaacctcgcagtactaaaactgaatgaacaaggcctgttggacaaattgaaaaacaaatggtggtacgacaaaggagagtgcggcagcgggggaggtgattccaaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttag

SEQ ID NO: 7188 - DNA, 1079 bp, synthetic construct
  misc_feature 1..1079: note = Synthetic polypeptide
  source 1..1079: mol_type = other DNA
ggccgggcgcggtggctcacacatgtaatcccagcactttgggaggctaaagcgggtggattacctgaggtcaggagtttgagaccagcctggcctacatggcggatctgtgcacaggactgcagggcttcctcatcttccacagctttgggggcggcactggctctgggttcgcatctctgctcatggagcggctctcagtggattacggcaagaagtccaagctagagtttgccatttacccagccccccaggtctccacagccgtggtggagccctacaactccatcctgaccacccacacgaccctggaacattctgactgtgccttcatggtcgacaatgaagccatctatgacatatgtcggcgcaacctggacattgaacgtcccacgtacaccaacctcaatcgcctgattgggcagatcgtgtcctccatcacagcctccctgcgatttgatggggccctgaatgtggacttgacggaattccagaccaacctagtgccgtacccccgcatccacttccccctggccacctatgccccagtcatctcagctgagaaggcctaccacgagcagctgtctgtggccgagatcaccaatgcctgcttcgagccagccaatcaaatggtcaagtgtgaccctcgccacggcaagtacatggcctgctgcatgttgtacaggggggacgtggtccccaaagacgtcaacgcggccatcgccaccatcaagaccaagcgcaccatccagtttgtggattggtgcccgactggatttaaggtgggcattaactaccagccccccacagtggtccccgggggagacctggccaaggtgcagcgggccgtgtgcatgctgagcaacaccacggccattgcggaggcctgggcccgcctggaccataagttcgatctcatgtatgccaagcgggcctttgtgcactggtacgtgggcgaaggcatggaagagggagagttctctgaggcccgcgaggacctggcagctctagagaaggattatgaagaggtgggcgtggattccgtggaagctgaggctgaagaaggcgaagaatactga

SEQ ID NO: 7189 - DNA, 658 bp, synthetic construct
  misc_feature 1..658: note = Synthetic polypeptide
  source 1..658: mol_type = other DNA
gtgtcctattaggaactggcctgcacagcaggaggtgagtgactggcaagcgagcgaagcttcatctgtatttacagtcactccccattgctcgcattactgcccaagctctgcctcctgtctgatcagccatggcattggattcttataggagagtgaaccgtattgtgaacggcacatgtgagggatctaggttgcgtgcttcttatgagaatctgatgcctgatgatctgtcaccgtctcccatcaccaccagatgggaccgtctggttgcaggaaaataagctcagggctccaactgattctacattatgccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccac

SEQ ID NO: 7190 - DNA, 1999 bp, synthetic construct
  misc_feature 1..1999: note = Synthetic polypeptide
  source 1..1999: mol_type = other DNA
gtgtcctattaggaactggcctgcacagcaggaggtgagtgactggcaagcgagcgaagcttcatctgtatttacagtcactccccattgctcgcattactgcccaagctctgcctcctgtctgatcagccatggcattggattcttataggagagtgaaccgtattgtgaacggcacatgtgagggatctaggttgcgtgcttcttatgagaatctgatgcctgatgatctgtcaccgtctcccatcaccaccagatgggaccgtctggttgcaggaaaataagctcagggctccaactgattctacattatgccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtag

SEQ ID NO: 7191 - DNA, 671 bp, synthetic construct
  misc_feature 1..671: note = Synthetic polypeptide
  source 1..671: mol_type = other DNA
gtgtcctattaggaactggcctgcacagcaggaggtgagtgactggcaagcgagcgaagcttcatctgtatttacagtcactccccattgctcgcattactgcccaagctctgcctcctgtctgatcagccatggcattggattcttataggagagtgaaccgtattgtgaacggcacatgtgagggatctaggttgcgtgcttcttatgagaatctgatgcctgatgatctgtcaccgtctcccatcaccaccagatgggaccgtctggttgcaggaaaataagctcagggctccaactgattctacattatgccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaac

SEQ ID NO: 7192 - DNA, 739 bp, synthetic construct
  misc_feature 1..739: note = Synthetic polypeptide
  source 1..739: mol_type = other DNA
gtgtcctattaggaactggcctgcacagcaggaggtgagtgactggcaagcgagcgaagcttcatctgtatttacagtcactccccattgctcgcattactgcccaagctctgcctcctgtctgatcagccatggcattggattcttataggagagtgaaccgtattgtgaacggcacatgtgagggatctaggttgcgtgcttcttatgagaatctgatgcctgatgatctgtcaccgtctcccatcaccaccagatgggaccgtctggttgcaggaaaataagctcagggctccaactgattctacattatgccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccc

SEQ ID NO: 7193 - DNA, 854 bp, synthetic construct; identical to SEQ ID NO: 6577
  misc_feature 1..854: note = Synthetic polypeptide
  source 1..854: mol_type = other DNA

SEQ ID NO: 7194 - DNA, 2578 bp, synthetic construct
  misc_feature 1..2578: note = Synthetic polypeptide
  source 1..2578: mol_type = other DNA
cttggaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacataacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataa

SEQ ID NO: 7195 - DNA, 2305 bp, synthetic construct
  misc_feature 1..2305: note = Synthetic polypeptide
  source 1..2305: mol_type = other DNA
cttggaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacataacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataa

SEQ ID NO: 7196 - DNA, 1759 bp, synthetic construct
  misc_feature 1..1759: note = Synthetic polypeptide
  source 1..1759: mol_type = other DNA
cttggaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataa

SEQ ID NO: 7197 - DNA, 353 bp, synthetic construct
  misc_feature 1..353: note = Synthetic polypeptide
  source 1..353: mol_type = other DNA
tggtttctaaattgagtctctggacaggtgctggcctatggtaaggttttcactgacccaggccaaaataagaaaactaaaggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatga

SEQ ID NO: 7198 - DNA, 121 bp, synthetic construct
  misc_feature 1..121: note = Synthetic polypeptide
  source 1..121: mol_type = other DNA
tggtttctaaattgagtctctggacaggtgctggcctatggtaaggttttcactgacccaggccaaaataagaaaactaaaggttagagccacagctgaaacaactacaaacaaaatatga

SEQ ID NO: 7199 - DNA, 1571 bp, synthetic construct; identical to SEQ ID NO: 6810
  misc_feature 1..1571: note = Synthetic polypeptide
  source 1..1571: mol_type = other DNA

SEQ ID NO: 7200 - DNA, 549 bp, synthetic construct; identical to SEQ ID NO: 876
  misc_feature 1..549: note = Synthetic polypeptide
  source 1..549: mol_type = other DNA

SEQ ID NO: 7201 - DNA, 277 bp, synthetic construct
  misc_feature 1..277: note = Synthetic polypeptide
  source 1..277: mol_type = other DNA
ggctgggcgctatggttcacgcctgtaatcccagcactttgggaggcggaggcaggcagattgcttgagcctaggagttcaagagcagactggggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtag

SEQ ID NO: 7202 - DNA, 126 bp, synthetic construct
  misc_feature 1..126: note = Synthetic polypeptide
  source 1..126: mol_type = other DNA
ggctgggcgctatggttcacgcctgtaatcccagcactttgggaggcggaggcaggcagattgcttgagcctaggagttcaagagcagactggggcacctgtgctggttgcacttgctttgattga

SEQ ID NO: 7203 - DNA, 286 bp, synthetic construct
  misc_feature 1..286: note = Synthetic polypeptide
  source 1..286: mol_type = other DNA
ggtcgggcaccatagctcatgcttgtaatcccggcactttgggaggccaaggcaagtggatcaactgaggctggtgaacgaggtgttcaccatcgacgacaccctgcagaccctcaagctgcggctgcgggagacacaggacacgctgcagctgctggtcatgaccaagtgccggctggagcacgagctcgccatcaaggccaacaccctctgcatcgacaaggagaagtgcatgggcatgcgtaagaccttcccctgcaccccgcgcctggtgggccacacctga

SEQ ID NO: 7204 - DNA, 1079 bp, synthetic construct; identical to SEQ ID NO: 6652
  misc_feature 1..1079: note = Synthetic polypeptide
  source 1..1079: mol_type = other DNA

SEQ ID NO: 7205 - DNA, 144 bp, synthetic construct
  misc_feature 1..144: note = Synthetic polypeptide
  source 1..144: mol_type = other DNA
tcactgtctttgctctgccttcagcccagggcctgccagctcgctgatgtgcttctcctgcttgaaccagaagagcaatctgtactgcctgaagccgaccatctgctccgaccaggacaactactgcgtgactgtgtctgctag

SEQ ID NO: 7206 - DNA, 379 bp, synthetic construct
  misc_feature 1..379: note = Synthetic polypeptide
  source 1..379: mol_type = other DNA
tcactgtctttgctctgccttcagcccagggcctgccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctga

SEQ ID NO: 7207 - DNA, 205 bp, synthetic construct
  misc_feature 1..205: note = Synthetic polypeptide
  source 1..205: mol_type = other DNA
tcactgtctttgctctgccttcagcccagggcctgccagctcgctgatgtgcttctcctgcttgaaccagaagagcaatctgtactgcctgaagccgaccatctgctccgaccaggacaactactgcgtgactgtgtctgctagtgccggcattggtgagtgccaggcctcagaccgtgccttcctcccctggccatctccctag

SEQ ID NO: 7208 - DNA, 184 bp, synthetic construct
  misc_feature 1..184: note = Synthetic polypeptide
  source 1..184: mol_type = other DNA
tcactgtctttgctctgccttcagcccagggcctgccagctcgctgatgtgcttctcctgcttgaaccagaagagcaatctgtactgcctgaagccgaccatctgctccgaccaggacaactactgcgtgactgtgtctgctagtgccggcattgcctcatttcccatgcagggaatctcgtga

SEQ ID NO: 7209 - DNA, 184 bp, synthetic construct
  misc_feature 1..184: note = Synthetic polypeptide
  source 1..184: mol_type = other DNA
tcactgtctttgctctgccttcagcccagggcctgccagctcgctgatgtgcttctcctgcttgaaccagaagagcaatctgtactgcctgaagccgaccatctgctccgaccaggacaactactgcgtgactgtgtctgctagtgccggcattggtggctttgctggagggacagacagttga

SEQ ID NO: 7210 - DNA, 295 bp, synthetic construct
  misc_feature 1..295: note = Synthetic polypeptide
  source 1..295: mol_type = other DNA
gactctggaattagactgcctgagatcaaattccaattccatgtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagc

SEQ ID NO: 7211 - DNA, 1077 bp, synthetic construct
  misc_feature 1..1077: note = Synthetic polypeptide
  source 1..1077: mol_type = other DNA
gactctggaattagactgcctgagatcaaattccaattccatgtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatccatctacacatgccttggagttgacattgaaaattttcttgataaagaaagtgaaagaattactttaatacctctgaatgaggtttttcaagtgtcacaggagggggctggcaataaccttatccttcaaagcataaacaagacctgcagccattatgagtgtgcatttctaggtggactaaaaaccgaaaactgtattgagaacctagaatattttcaacccatctatgtctacaaccctggtgagaaaaaccagaagcttgaagaccatagtgagaaaaactggaagcttgaagaccatggtgagaaaaaccagaagcttgaagaccatggtgtgaaaatccttgaacccacccaaatacctgctccaggtccagttcctgttccaggtcccaaaagccatccttctgcatcctcgggcaaactgctgcttccacagtttgggatggtcatcattttaatcagtgtttctgctataaatctctttgttgctctgtag

SEQ ID NO: 7212 - DNA, 578 bp, synthetic construct
  misc_feature 1..578: note = Synthetic polypeptide
  source 1..578: mol_type = other DNA
gactctggaattagactgcctgagatcaaattccaattccatgtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatc

SEQ ID NO: 7213 - DNA, 362 bp, synthetic construct
  misc_feature 1..362: note = Synthetic polypeptide
  source 1..362: mol_type = other DNA
gactctggaattagactgcctgagatcaaattccaattccatgtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatat

SEQ ID NO: 7214 - DNA, 1110 bp, synthetic construct
  misc_feature 1..1110: note = Synthetic polypeptide
  source 1..1110: mol_type = other DNA
gactctggaattagactgcctgagatcaaattccaattccatgtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatccatctacacatgccttggagttgacattgaaaattttcttgataaagaaagtgaaagaattactttaatacctctgaatgaggtttttcaagtgtcacaggagggggctggcaataaccttatccttcaaagcataaacaagacctgcagccattatgagtgtgcatttctaggtggactaaaaaccgaaaactgtattgagaacctagaatattttcaacccatctatgtctacaaccctggtgagaaaaaccagaagcttgaagaccatagtgagaaaaactggaagcttgaagaccatggtgagaaaaaccagaagcttgaagaccatggtgtgaaaatccttgaacccacccaaatacctgaagataaaagtcaaggaaatatcaacaatcctactccaggtccagttcctgttccaggtcccaaaagccatccttctgcatcctcgggcaaactgctgcttccacagtttgggatggtcatcattttaatcagtgtttctgctataaatctctttgttgctctgtag

SEQ ID NO: 7215 - DNA, 1143 bp, synthetic construct
  misc_feature 1..1143: note = Synthetic polypeptide
  source 1..1143: mol_type = other DNA
gactctggaattagactgcctgagatcaaattccaattccatgtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatccatctacacatgccttggagttgacattgaaaattttcttgataaagaaagtgaaagaattactttaatacctctgaatgaggtttttcaagtgtcacaggagggggctggcaataaccttatccttcaaagcataaacaagacctgcagccattatgagtgtgcatttctaggtggactaaaaaccgaaaactgtattgagaacctagaatattttcaacccatctatgtctacaaccctggtgagaaaaaccagaagcttgaagaccatagtgagaaaaactggaagcttgaagaccatggtgagaaaaaccagaagcttgaagaccatggtgtgaaaatccttgaacccacccaaatacctggaatgaaaattccagaaccttttccactacctgaagataaaagtcaaggaaatatcaacaatcctactccaggtccagttcctgttccaggtcccaaaagccatccttctgcatcctcgggcaaactgctgcttccacagtttgggatggtcatcattttaatcagtgtttctgctataaatctctttgttgctctgtag

SEQ ID NO: 7216 - DNA, 497 bp, synthetic construct
  misc_feature 1..497: note = Synthetic polypeptide
  source 1..497: mol_type = other DNA
gactctggaattagactgcctgagatcaaattccaattccatgtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggct

SEQ ID NO: 7217 - DNA, 644 bp, synthetic construct
  misc_feature 1..644: note = Synthetic polypeptide
  source 1..644: mol_type = other DNA
ggccgggtgtggtggttcatgcctctcatcccagcacttcaggaggctgaggaggggagctggcactgtctgcattcttagtgctagtatttctgtggctgcacagcttacgaagactcttcgagtgcctctacgtcagtgtcttctccaatgtcatgattcacgtcgtgcagtactgttttggacttgtctattatgtccttgttggcctaactgtgctgagccaagtgccaatggatggcaggaatgcctacataacagggaaaaatctattgatgcaagcacggtggttccatattcttgggatgatgatgttcatctggtcatctgcccatcagtataagtgccatgttattctcggcaatctcaggaaaaataaagcaggagtggtcattcactgtaaccacaggatcccatttggagactggtttgaatatgtttcttcccctaactacttagcagagctgatgatctacgtttccatggccgtcacctttgggttccacaacttaacttggtggctagtggtgacaaatgtcttctttaatcaggccctgtctgcctttctcagccaccaattctacaaaagcaaatttgtctcttacccgaagcataggaaagctttcctaccatttttgttttaa

SEQ ID NO: 7218 - DNA, 677 bp, synthetic construct; identical to SEQ ID NO: 747
  misc_feature 1..677: note = Synthetic polypeptide
  source 1..677: mol_type = other DNA

SEQ ID NO: 7219 - DNA, 674 bp, synthetic construct; identical to SEQ ID NO: 748
  misc_feature 1..674: note = Synthetic polypeptide
  source 1..674: mol_type = other DNA

SEQ ID NO: 7220 - DNA, 711 bp, synthetic construct
  misc_feature 1..711: note = Synthetic polypeptide
  source 1..711: mol_type = other DNA
ccttgccctgtgcgcctcctccgcgtggctgttcctgaatacgctggtgtctgttcgcatcttttagaatacgctggtgtcggtgcgcacagcgcttctcttagttctgaactcttaacattcagggatgtggccatagaattctctccagaagagtggaaatgcctggaccctgaccagcagaatttgtatagagatgtgatgttggagaactacaggaacctggtctccctgggtgttgctatctctaacccagacctggtcacctgtctggagcaaagaaaagagccctacaatgtgaagatacataagatcgtagccagacccccagctatgtgttctcatttcacccaagaccattggccagtgcagggcatagaagattcattccacaaacttatactgagaagatatgagaaatgtggacatgataatttacaattaagaaaaggctgtaaaagtttgaatgagtgtaagttgcagaaaggaggttataatgaatttaatgaatgcttgtcaactacccagagcaaaatacttcagtgtaaagcaagtgtcaaagttgttagtaaattttcaaattcaaacaaacgtaagacaagacatactggagagaaacactttaaagaatgtggcaaatcatttcagaagttttcacacctaactcaacataagaattcttccatctctatgacaacaagcccattttag

SEQ ID NO: 7221 - DNA, 447 bp, synthetic construct
  misc_feature 1..447: note = Synthetic polypeptide
  source 1..447: mol_type = other DNA
ccttgccctgtgcgcctcctccgcgtggctgttcctgaatacgctggtgtctgttcgcatcttttagaatacgctggtgtcggtgcgcacagcgcttctcttagttctgaactcttaacattcagggatgtggccatagaattctctccagaagagtggaaatgcctggaccctgaccagcagaatttgtatagagatgtgatgttggagaactacaggaacctggtctccctgggtgttgctatctctaacccagacctggtcacctgtctggagcaaagaaaagagccctacaatgtgaagatacataagatcgtagccagacccccagaattcttccatctctatgacaacaagcccattttagctttctggagaatagcatctgagaaaagccaaagtgcctcagtttacagacagctcactcacagaagcagagccacctaa

SEQ ID NO: 7222 - DNA, 1530 bp, synthetic construct
  misc_feature 1..1530: note = Synthetic polypeptide
  source 1..1530: mol_type = other DNA
ccttgccctgtgcgcctcctccgcgtggctgttcctgaatacgctggtgtctgttcgcatcttttagaatacgctggtgtcggtgcgcacagcgcttctcttagttctgaactcttaacattcagggatgtggccatagaattctctccagaagagtggaaatgcctggaccctgaccagcagaatttgtatagagatgtgatgttggagaactacaggaacctggtctccctgggtgttgctatctctaacccagacctggtcacctgtctggagcaaagaaaagagccctacaatgtgaagatacataagatcgtagccagacccccagctatgtgttctcatttcacccaagaccattggccagtgcagggcatagaagattcattccacaaacttatactgagaagatatgagaaatgtggacatgataatttacaattaagaaaaggctgtaaaagtttgaatgagtgtaagttgcagaaaggaggttataatgaatttaatgaatgcttgtcaactacccagagcaaaatacttcagtgtaaagcaagtgtcaaagttgttagtaaattttcaaattcaaacaaacgtaagacaagacatactggagagaaacactttaaagaatgtggcaaatcatttcagaagttttcacacctaactcaacataaggtaattcatgctggagagaaaccctacacttgtgaagaatgtggcaaagcctttaaatggtctttaatatttaatgaacataagagaattcatactggagagaaaccttttacttgtgaagaatgtggcagcatctttaccacatcctcacactttgctaagcataaaataattcatactggagaaaaaccctataaatgtgaagaatgtggcaaagcctttaataggttcacaacccttactaaacataagagaattcatgctggagagaaacccatcacatgtgaagaatgtaggaaaatctttacctcatcctcaaactttgccaaacataagcgaattcatactggagagaaaccctacaaatgtgaagaatgtggcaaagcctttaataggtccacaacccttactaaacataagagaattcatactggagagaaaccctacacatgtgaagaatgtggcaaagcttttagacagtcctcaaaactgaatgaacataagaaagttcatactggagagcggccctacaaatgtgatgaatgtggcaaagcctttggacggtccagggtcctgaatgaacataaaaaaattcatactggagagaaaccctacaaatgtgaagaatgtggcaaagcctttagacggtccacagatcggagtcaacataagaaaattcatagtgcagataaaccctacaaatgtaaagaatgtgacaaagcctttaaacaattttcgctcctgagtcaacataagaaaattcatactgtagataaaccctacaaatgtaaagattgtgacaaagcctttaaacggttctcacacctgaataaacataagaaaattcatacttga

SEQ ID NO: 7223 - DNA, 1295 bp, synthetic construct
  misc_feature 1..1295: note = Synthetic polypeptide
  source 1..1295: mol_type = other DNA
tggtatggtttggctgtgtccccacccaaatctcatcttggattcccatgtattgtgggagggacccggtgggaggtaactgaatcatgggggcaggcctttctcatgctgtttttgtgatagtgaacaagtctcatgagatctgatggttttgaaaaggggagtttccctgcacaagctctcttctcttgtctgcttccaggtgagacatgcctttcaccttctgccatgattgtgaggcctctccagccatgtggaactgtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataa

SEQ ID NO: 7224 - DNA, 1235 bp, synthetic construct
  misc_feature 1..1235: note = Synthetic polypeptide
  source 1..1235: mol_type = other DNA
tggtatggtttggctgtgtccccacccaaatctcatcttggattcccatgtattgtgggagggacccggtgggaggtaactgaatcatgggggcaggcctttctcatgctgtttttgtgatagtgaacaagtctcatgagatctgatggttttgaaaaggggagtttccctgcacaagctctcttctcttgtctgcttccaggtgagacatgcctttcaccttctgccatgattgtgaggcctctccagccatgtggaactgtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataa

SEQ ID NO: 7225 - DNA, 590 bp, synthetic construct
  misc_feature 1..590: note = Synthetic polypeptide
  source 1..590: mol_type = other DNA
tggtatggtttggctgtgtccccacccaaatctcatcttggattcccatgtattgtgggagggacccggtgggaggtaactgaatcatgggggcaggcctttctcatgctgtttttgtgatagtgaacaagtctcatgagatctgatggttttgaaaaggggagtttccctgcacaagctctcttctcttgtctgcttccaggtgagacatgcctttcaccttctgccatgattgtgaggcctctccagccatgtggaactgtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtatcataactattgtggattcaaaatatggattaaaagtgaaataccactaa

SEQ ID NO: 7226 - DNA, 449 bp, synthetic construct
  misc_feature 1..449: note = Synthetic polypeptide
  source 1..449: mol_type = other DNA
tggtatggtttggctgtgtccccacccaaatctcatcttggattcccatgtattgtgggagggacccggtgggaggtaactgaatcatgggggcaggcctttctcatgctgtttttgtgatagtgaacaagtctcatgagatctgatggttttgaaaaggggagtttccctgcacaagctctcttctcttgtctgcttccaggtgagacatgcctttcaccttctgccatgattgtgaggcctctccagccatgtggaactgtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaagtga

SEQ ID NO: 7227 - DNA, 431 bp, synthetic construct
  misc_feature 1..431: note = Synthetic polypeptide
  source 1..431: mol_type = other DNA
ggctgggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtacctgaaatgctgcacaatgatgctagtgaccatggatgtagccgctgggggtatttctttttacagaatgctgggatgcttttgggttttggaattatgttacttatttccatatttgaacataaaatcgtgtttcgtataaatttctag

SEQ ID NO: 7228 - DNA, 290 bp, synthetic construct
  misc_feature 1..290: note = Synthetic polypeptide
  source 1..290: mol_type = other DNA
ggctgggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtaagtttttaa

SEQ ID NO: 7229 - DNA, 281 bp, synthetic construct
  misc_feature 1..281: note = Synthetic polypeptide
  source 1..281: mol_type = other DNA
ggctgggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggta

SEQ ID NO: 7230 - DNA, 821 bp, synthetic construct
  misc_feature 1..821: note = Synthetic polypeptide
  source 1..821: mol_type = other DNA
aggaaaaggcagacaacgaatttaaaaatggacaaaagagttgaacagacactgcctaaaaatgactaaccagatgtcaatgagcaggtgaagagttgtttgacaacatcagtcatcagagaaatgcaaatatgaaccacagtagacatgacccaccagcattgctaagaaggacgaccactgtaccaagtgctggtgaagatctggagcaaccacatctctcagtcacttctgataggagtgtcagttactaaaactgttttggaaaccatttgatagtttcaaatacagctgaacacacacacactctataacccagcatttgcaacacgtaagagtatgactatcagaaatacgtacatatgtttatcagaagatctataggaaagtgatcatagcagcacaattctagtaaccacaaactggaaactaacaaaaagcccaacagcaagataatgaacaaatacattatggaatgttcacatggtggaatactgtactgcagtgaaaatgagcaaactattgctacgcataacaacatggttggatctcacaaacatgatgctgaacaaaaggagcttgctgcccttgaatttcctccaaagaaactatttggaaataaggatgaacgtgtgattgctgagagacgaagtcacttagagaaatacctcagggactttttcagcgtgatgctccagtccgcaacatctcccctccacatcaacaaagtgggactgactctctcgaaacataccatttgtgagttttcaccattcttcaagaaaggagtctttgactacagcagccacgggacggggtag

SEQ ID NO: 7231 - DNA, 1358 bp, synthetic construct
  misc_feature 1..1358: note = Synthetic polypeptide
  source 1..1358: mol_type = other DNA
ggccgggtgcagtggcccacacctgtaatcccagcactttggcaggccgagcttttttattaagctgtgctgatggcataaatggaacagttaactggaagaccagacaggccaacaattttattatcagcagaaaaatggctgctgggatgaaagatgtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggtgagtgctaa

SEQ ID NO: 7232 - DNA, 333 bp, synthetic construct; identical to SEQ ID NO: 6583
  misc_feature 1..333: note = Synthetic polypeptide
  source 1..333: mol_type = other DNA

SEQ ID NO: 7233 - DNA, 1256 bp, synthetic construct
  misc_feature 1..1256: note = Synthetic polypeptide
  source 1..1256: mol_type = other DNA
ggccgggtgcagtggcccacacctgtaatcccagcactttggcaggccgagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggtaaatggtatccctga

SEQ ID NO: 7234 - DNA, 1331 bp, synthetic construct
  misc_feature 1..1331: note = Synthetic polypeptide
  source 1..1331: mol_type = other DNA
ggccgggtgcagtggcccacacctgtaatcccagcactttggcaggccgagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcaatggagtttcgctcctgttgcccaggctggagtgcaatggagcgatcttggctcactgcagcctccgcctcccaggaacttgccacatcagactcagattccccaacagcagactacaggtaaatggtatccctga

SEQ ID NO: 7235 - DNA, 1229 bp, synthetic construct
  misc_feature 1..1229: note = Synthetic polypeptide
  source 1..1229: mol_type = other DNA
ggccgggtgcagtggcccacacctgtaatcccagcactttggcaggccgagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtcatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggtaaatggtatccctga

SEQ ID NO: 7236 - DNA, 1298 bp, synthetic construct
  misc_feature 1..1298: note = Synthetic polypeptide
  source 1..1298: mol_type = other DNA
ggccgggtgcagtggcccacacctgtaatcccagcactttggcaggccgagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtcatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggagattttcgtttgacaacttttcaaagatttgaggtaaatggtatccctgaagaaagaaaactgactgaagcaatgaatttataa

SEQ ID NO: 7237 - DNA, 1250 bp, synthetic construct
  misc_feature 1..1250: note = Synthetic polypeptide
  source 1..1250: mol_type = other DNA
ggccgggtgcagtggcccacacctgtaatcccagcactttggcaggccgagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggtgagtgctaa

SEQ ID NO: 7238 - DNA, 1530 bp, synthetic construct
  misc_feature 1..1530: note = Synthetic polypeptide
  source 1..1530: mol_type = other DNA
aatttcatttccttccttcacagggttgttatgaactagactggtccaacaggaaagtatgatagatgtgaactggggcttcttttcaaccttttccggaagctctcaagctgttcttgtggataagacagagaatatgtactccaatgcaaagacttttggttgaattataactggctgaaggtgactgtaggacgaggatttggtgtcacataccaactggtatcaaaaatctgccccctgatgatttctcgaaaccactgtgttttgaagcagaatcctgagggccaatggacaattatggacaacaagagtctaaatggtgtttggctgaacagagcgcgtctggaacctttaagggtctattccattcatcagggagactacatccaacttggagtgcctctggaaaataaggagaatgcggagtatgaatatgaagttactgaagaagactgggagacaatatatccttgtctttccccaaagaatgaccaaatgatagaaaaaaataaggaattgagaactaaaaggaaattcagtttggatgaattagcaggtcctggagctgaaggcccctcaaatttgaaatccaaaataaataaagtgtcttgtgaatctggtcagccagtgaaatcacaggggaaaggtgaagtggccagtacaccctctgacaatttggatcctaagttgactgcccttgagccaagtaagaccacaggggctcccatttaccctggcttccccaaagtcacagaggttcatcatgagcagaaagcctcaaactcttcagcatctcagagaagcttacagatgtttaaggtgaccatgtccaggattctgaggctcaaaatacagatgcaggaaaaacatgaagccgttatgaatgtgaaaaagcagacccaaaaggggaactcaaagaaagttgtgcaaatggagcaggaacttcaggacttacagtcccagctgtgtgcagagcaggctcagcagcaggcaagagtggagcaactagagaagactttccaggaagaggaacagcatcttcagggtttggagatagcccaaggagaaaaggacctgaagcaacagctggcccaggctctgcaggagcattgggctctaatggaagagctaaatcgcagcaagaaggactttgaagcaatcattcaagccaagaacaaagaattagagcagaccaaggaagagaaggagaagatgcaagcacagaaggaagaagttcttagccacatgaatgatgtgctagagaatgagctccaatgtattatttgttcagaatacttcattgaggctgtcaccttgaactgtgcccacagtttctgctcctactgtatcaatgaatggatgaagcggaagatagaatgccccatttgtcggaaggacattaagtccaaaacgtactctttggttctggacaattgcattaataagatggtaaataatctgagctcagaagtgaaagaacgacgaattgttctcattagggaacgaaaagcaaagagattgttctga

SEQ ID NO: 7239 - DNA, 369 bp, synthetic construct
  misc_feature 1..369: note = Synthetic polypeptide
  source 1..369: mol_type = other DNA
aatttcatttccttccttcacagggttgttatgaactagactggtccaacaggaaagtatgatagatgtgaactggggcttcttttcaaccttttccggaagctctcaagctgttcttgtggataagacagagaatatgtactccaatgcaaagacttttggttgaattataactggctgaaggtgactgtaggacgaggatttggtgtcacataccaactggtatcaaaaatctgccccctgatgatttctcgaaaccactgtgttttgaagcagaatcctgagggccaatggacaattatggacaacaagagttttccttctgaaaaggcagaagattttacagcagcaggagagagattcctttaa

SEQ ID NO: 7240 - DNA, 342 bp, synthetic construct
  misc_feature 1..342: note = Synthetic polypeptide
  source 1..342: mol_type = other DNA
aatttcatttccttccttcacagggttgttatgaactagactggtccaacaggaaagtatgatagatgtgaactggggcttcttttcaaccttttccggaagctctcaagctgttcttgtggataagacagagaatatgtactccaatgcaaagacttttggttgaattataactggctgaaggtgactgtaggacgaggatttggtgtcacataccaactggtatcaaaaatctgccccctgatgatttctcgaaaccactgtgttttgaagcagaatcctgagggccaatggacaattatggacaacaaggggaccaccagtttgtctaaggagaggtga

SEQ ID NO: 7241 - DNA, 1419 bp, synthetic construct
  misc_feature 1..1419: note = Synthetic polypeptide
  source 1..1419: mol_type = other DNA
aatttcatttccttccttcacagggttgttatgaactagactggtccaacaggaaagtatgatagatgtgaactggggcttcttttcaaccttttccggaagctctcaagctgttcttgtggataagacagagaatatgtactccaatgcaaagacttttggttgaattataactggctgaaggtgactgtaggacgaggatttggtgtcacataccaactggtatcaaaaatctgccccctgatgatttctcgaaaccactgtgttttgaagcagaatcctgagggccaatggacaattatggacaacaagagtctaaatggtgtttggctgaacagagcgcgtctggaacctttaagggtctattccattcatcagggagactacatccaacttggagtgcctctggaaaataaggagaatgcggagtatgaatatgaagttactgaagaagactgggagacaatatatccttgtctttccccaaagaatgaccaaatgatagaaaaaaataaggaattgagaactaaaaggaaattcagtttggatgaattagcaggtcctggagctgaaggcccctcaaatttgaaatccaaaataaataaagtgtcttgtgaatctggtcagccagtgaaatcacaggggaaaggtgaagtggccagtacaccctctgacaatttggatcctaagttgactgcccttgagccaagtaagaccacaggggctcccatttaccctggcttccccaaagtcacagaggttcatcatgagcagaaagcctcaaactcttcagcatctcagagaagcttacagatgtttaaggtgaccatgtccaggattctgaggctcaaaatacagatgcaggaaaaacatgaagccgttatgaatgtgaaaaagcagacccaaaaggggaactcaaagaaagttgtgcaaatggagcaggaacttcaggacttacagtcccagctgtgtgcagagcaggctcagcagcaggcaagagtggagcaactagagaagactttccaggaagaggaacagcatcttcagggtttggagatagcccaaggagaaaaggacctgaagcaacagctggcccaggctctgcaggagcattgggctctaatggaagagctaaatcgcagcaagaaggactttgaagcaatcattcaagccaagaacaaagaattagagcagaccaaggaagagaaggagaagatgcaagcacagaaggaagaagttcttagccacatgaatgatgtgctagagaatgagctccaatgtattatttgttcagaatacttcattgagcaaagagattgttctgaagaccgtgctctaagggcatttgaaagactgccaggtagtgcgagcctgagatggtctggaggattctctctagccgtgactccgctgctctga

SEQ ID NO: 7242 - DNA, 229 bp, synthetic construct
  misc_feature 1..229: note = Synthetic polypeptide
  source 1..229: mol_type = other DNA
cacacactctctgcactgttcctaggtgagtcacctaacctccctgagtctcagtttcctcacctatacaatggggataatattaaatcttccacacaggatcagcataaggattaagttacgagaactggtcagcatgtgcatctgccctgacccccaccagagacctgacatcggatacgtgcaccaggtggccaagcagatgcacatctggatgtccagcacctga

SEQ ID NO: 7243 - DNA, 924 bp, synthetic construct
  misc_feature 1..924: note = Synthetic polypeptide
  source 1..924: mol_type = other DNA
aggttctttgcagtagaattttctcagccaggaatgatcttcccccagatatttgcatggcttctttcacttagctgatctctgttctgatatcagctgcctagagagaattttcttgaccacattcaaagttagtggcctctccaccttggttttgttcatgaatattcaagaagacatcctcagcttgctgtctcagtaattctaagagttgctaaaggataccaggagttattggagaagtgtttccagactgaaaaccctcttgaatgccaagataaaggagaagaagaattacagaaatacatccaggagagccaagcattggcaaagcgaagctgcggcctcttccagaaactaggagaatattacttacaaaatgcgtttctcgttgcttacacaaagaaagccccccagctgacctcgtcggagctgatggccatcaccagaaaaatggcagccacagcagccacttgttgccaactcagtgaggacaaactattggcctgtggcgagggagcggctgacattattatcggacacttatgtatcagacatgaaatgactccagtaaaccctggtgttggccagtgctgcacttcttcatatgccaacaggaggccatgcttcagcagcttggtggtggatgaaacatatgtccctcctgcattctctgatgacaagttcattttccataaggatctgtgccaagctcagggtgtagcgctgcaaacaatgaagcaagagtttctcattaaccttgtgaagcaaaagccacaaataacagaggaacaacttgaggctgtcattgcagatttctcaggcctgttggagaaatgctgccaaggccaggaacaggaagtctgctttgctgaagagggacaaaaactgatttcaaaaactcgtgctgctttgggagtttaa

SEQ ID NO: 7244 - DNA, 963 bp, synthetic construct
  misc_feature 1..963: note = Synthetic polypeptide
  source 1..963: mol_type = other DNA
aggttctttgcagtagaattttctcagccaggaatgatcttcccccagatatttgcatggcttctttcacttagctgatctctgttctgatatcagctgcctagagagaattttcttgaccacattcaaagttagtggcctctccaccttggttttgttcatgaatattcaagaagacatcctcagcttgctgtctcagtaattctaagagttgctaaaggataccaggagttattggagaagtgtttccagactgaaaaccctcttgaatgccaagataaaggagaagaagaattacagaaatacatccaggagagccaagcattggcaaagcgaagctgcggcctcttccagaaactaggagaatattacttacaaaatgcgtttctcgttgcttacacaaagaaagccccccagctgacctcgtcggagctgatggccatcaccagaaaaatggcagccacagcagccacttgttgccaactcagtgaggacaaactattggcctgtggcgagggagcggctgacattattatcggacacttatgtatcagacatgaaatgactccagtaaaccctggtgttggccagtgctgcacttcttcatatgccaacaggaggccatgcttcagcagcttggtggtggatgaaacatatgtccctcctgcattctctgatgacaagttcattttccataaggatctgtgccaagctcagggtgtagcgctgcaaacaatgaagcaagagtttctcattaaccttgtgaagcaaaagccacaaataacagaggaacaacttgaggctgtcattgcagatttctcaggcctgttggagaaatgctgccaaggccaggaacaggaagtctgctttgctgaagaggggaagagaagacaaaacgagtctttcattcggtgtgaacttttctctttaattttaactgatttaacactttttgtgaattaa

SEQ ID NO: 7245 - DNA, 1723 bp, synthetic construct
  misc_feature 1..1723: note = Synthetic polypeptide
  source 1..1723: mol_type = other DNA
gtgcggtggctcaagcctgtaatcccaacactttgggaggtcgaggcaggtggatcacgaggtcaggagttgaagaccagcctggccaacatagtgaaacctcatctctactaaaaatacaaaaaattagccaggcgtggtggcaggcacctgtagtcccagggtagatacaacaagaattgaatactccattcctttaagagaaaactgggcactaccatattttgcatgccaaattgctgcacttacaggctatttaaaaagcaacttaaatacttatggagagaggttttgctacttgttgatgagtgcttcaacttacacatttatgatgatgtgggagtatagccactatctcctgtttcttcaagcaatatctctattcctgctagataccttttcagtggagcaaagtgacaaggtttatgaagtttataaaatctacatattttccctctttctgggatatttactacagtttgagaatccagctttgttggtatctcctttattaagtttagtagcagccttaatgcttgctaagtgccttcagctgaatgtgaagaaaggaagttttgtagctaaaataataaaagtgattaatttttacttggtgtgtactctgacaataacattgaatattataatgaagatgtttgtcccacacaaagaaaatgggcacatgctgaaattccttgaagtaaaatttggactaaatatgaccaagaattttacaatgaattggctcctctgtcaagaatccctgcaggcaccatctcaagatttttttctgcgattgacacagtcttctttattacctttctacattctagtgttaattatttgttttctttctatgttgcaagttatttttaggaggattaatggtaagtccctgaaggaaactgttactcttgaagatggacgaattggagaaagaccagaaataatttatcatgtaattcacactattttattgggttctcttgcaatggttatagaaggcttgaagtacatctggattccttatgtgtgcatgttagcagcatttggtgtatgttctcccgaactttggatgacacttttcaagtggcttcgattaagaactgtacacccaatattgttggctcttattctgagcatggccgtgcctactataataggtctcagcttatggaaagagttttttcccagattaatgacagaattaatggaactacaggaattctatgacccagatacagtggaacttatgacctggataaaaaggcaagctccagttgcagctgtgtttgcagggagtccacagttaatgggtgcgattaaattatgcactggatggatggtgacaagtttgcctctttacaatgatgatgatcttctcaagagaaatgaaaatatctaccaaatctattcaaagcgatctgctgaggatatttataaaatactgacatcttacaaagctaattacctaattgtagaggatgctatctgcaatgaggtgggacccatgagaggctgtagggttaaagatttattagacattgcaaatggccacatggtttgtgaagaaggtgacaagctaacctactcaaaatatgggcgattttgtcatgaggtcaaaattaactattctccatatgtgaattatttcactagagtatactggaacagatcctactttgtatataaaatcaacactgtgatatccttccagtcttga

SEQ ID NO: 7246 - DNA, 849 bp, synthetic construct
  misc_feature 1..849: note = Synthetic polypeptide
  source 1..849: mol_type = other DNA
gtgcggtggctcaagcctgtaatcccaacactttgggaggtcgaggcaggtggatcacgaggtcaggagttgaagaccagcctggccaacatagtgaaacctcatctctactaaaaatacaaaaaattagccaggcgtggtggcaggcacctgtagtcccagggtagatacaacaagaattgaatactccattcctttaagagaaaactgggcactaccatattttgcatgccaaattgctgcacttacaggctatttaaaaagcaacttaaatacttatggagagaggttttgctacttgttgatgagtgcttcaacttacacatttatgatgatgtgggagtatagccactatctcctgtttcttcaagcaatatctctattcctgctagataccttttcagtggagcaaagtgacaagctgaatgtgaagaaaggaagttttgtagctaaaataataaaagtgattaatttttacttggtgtgtactctgacaataacattgaatattataatgaagatgtttgtcccacacaaagaaaatgggcacatgctgaaattccttgaagtaaaatttggactaaatatgaccaagaattttacaatgaattggctcctctgtcaagaatccctgcaggcaccatctcaagatttttttctgcgattgacacagtcttctttattacctttctacattctagtgttaattatttgttttctttctatgttgcaagttatttttaggaggattaatggtaagtccctgaaggaaactgttactcttgaagatggacgaattggagaaagaccagaaataatttatcatgtaattcacactattttattggg

SEQ ID NO: 7247 - DNA, 3556 bp, synthetic construct
  misc_feature 1..3556: note = Synthetic polypeptide
  source 1..3556: mol_type = other DNA
ccaggcacagtggctcactcctgtagtcctagcactctgggaggccaaggcagatgtattgcttgagctcaggagtttgagaccagcctgactaacatggtgaaacccgtctctactaaatatgaaaaattagctgggtgatatggcccacgtctgtaatcccagctacttgggagactgagaaggaacatctgcaggaacacctgatgaggctgcacccttggcggaaagaacacctgacacagctgaaagcttggtggaaaaaacacctgatgaggctgcacccttggtggaaagaacacctgacacggctgaaagcttggtggaaaaaacacctgatgaggctgcatccttggtggagggaacatctgacaaaattcaatgtttggagaaagcgacatctggaaagttcgaacagtcagcagaagaaacacctagggaaattacgagtcctgcaaaagaaacatctgagaaatttacgtggccagcaaaaggaagacctaggaagatcgcatgggagaaaaaagaagacacacctagggaaattatgagtcccgcaaaagaaacatctgagaaatttacgtgggcagcaaaaggaagacctaggaagatcgcatgggagaaaaaagaaacacctgtaaagactggatgcgtggcaagagtaacatctaataaaactaaagttttggaaaaaggaagatctaagatgattgcatgtcctacaaaagaatcatctacaaaagcaagtgccaatgatcagaggttcccatcagaatccaaacaagaggaagatgaagaatattcttgtgattctcggagtctctttgagagttctgcaaagattcaagtgtgtatacctgagtctatatatcaaaaagtaatggagataaatagagaagtagaagagcctcctaagaagccatctgccttcaagcctgccattgaaatgcaaaactctgttccaaataaagcctttgaattgaagaatgaacaaacattgagagcagatccgatgttcccaccagaatccaaacaaaaggactatgaagaaaattcttgggattctgagagtctctgtgagactgtttcacagaaggatgtgtgtttacccaaggctacacatcaaaaagaaatagataaaataaatggaaaattagaagagtctcctaataaagatggtcttctgaaggctacctgcggaatgaaagtttctattccaactaaagccttagaattgaaggacatgcaaactttcaaagcagagcctccggggaagccatctgccttcgagcctgccactgaaatgcaaaagtctgtcccaaataaagccttggaattgaaaaatgaacaaacattgagagcagatgagatactcccatcagaatccaaacaaaaggactatgaagaaaattcttgggatactgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacgcatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagattcaactagcctatcaaaaatcttggatacagttcattcttgtgaaagagcaagggaacttcaaaaagatcactgtgaacaacgtacaggaaaaatggaacaaatgaaaaagaagttttgtgtactgaaaaagaaactgtcagaagcaaaagaaataaaatcacagttagagaaccaaaaagttaaatgggaacaagagctctgcagtgtgagattgactttaaaccaagaagaagagaagagaagaaatgccgatatattaaatgaaaaaattagggaagaattaggaagaatcgaagagcagcataggaaagagttagaagtgaaacaacaacttgaacaggctctcagaatacaagatatagaattgaagagtgtagaaagtaatttgaatcaggtttctcacactcatgaaaatgaaaattatctcttacatgaaaattgcatgttgaaaaaggaaattgccatgctaaaactggaaatagccacactgaaacaccaataccaggaaaaggaaaataaatactttgaggacattaagattttaaaagaaaagaatgctgaacttcagatgaccctaaaactgaaagaggaatcattaactaaaagggcatctcaatatagtgggcagcttaaagttctgatagctgagaacacaatgctcacttctaaattgaaggaaaaacaagacaaagaaatactagaggcagaaattgaatcacaccatcctagactggcttctgctgtacaagaccatgatcaaattgtgacatcaagaaaaagtcaagaacctgctttccacattgcaggagatgcttgtttgcaaagaaaaatgaatgttgatgtgagtagtacgatatataacaatgaggtgctccatcaaccactttctgaagctcaaaggaaatccaaaagcctaaaaattaatctcaattatgcaggagatgctctaagagaaaatacattggtttcagaacatgcacaaagagaccaacgtgaaacacagtgtcaaatgaaggaagctgaacacatgtatcaaaacgaacaagataatgtgaacaaacacactgaacagcaggagtctctagatcagaaattatttcaactacaaagcaaaaatatgtggcttcaacagcaattagttcatgcacataagaaagctgacaacaaaagcaagataacaattgatattcattttcttgagaggaaaatgcaacatcatctcctaaaagagaaaaatgaggagatatttaattacaataaccatttaaaaaaccgtatatatcaatatgaaaaagagaaagcagaaacagaaaactcatga

SEQ ID NO: 7248 - DNA, 3913 bp, synthetic construct
  misc_feature 1..3913: note = Synthetic polypeptide
  source 1..3913: mol_type = other DNA
ccaggcacagtggctcactcctgtagtcctagcactctgggaggccaaggcagatgtattgcttgagctcaggagtttgagaccagcctgactaacatggtgaaacccgtctctactaaatatgaaaaattagctgggtgatatggcccacgtctgtaatcccagctacttgggagactgagaaggaacatctgcaggaacacctgatgaggctgcacccttggcggaaagaacacctgacacagctgaaagcttggtggaaaaaacacctgatgaggctgcacccttggtggaaagaacacctgacacggctgaaagcttggtggaaaaaacacctgatgaggctgcatccttggtggagggaacatctgacaaaattcaatgtttggagaaagcgacatctggaaagttcgaacagtcagcagaagaaacacctagggaaattacgagtcctgcaaaagaaacatctgagaaatttacgtggccagcaaaaggaagacctaggaagatcgcatgggagaaaaaagaagacacacctagggaaattatgagtcccgcaaaagaaacatctgagaaatttacgtgggcagcaaaaggaagacctaggaagatcgcatgggagaaaaaagaaacacctgtaaagactggatgcgtggcaagagtaacatctaataaaactaaagttttggaaaaaggaagatctaagatgattgcatgtcctacaaaagaatcatctacaaaagcaagtgccaatgatcagaggttcccatcagaatccaaacaagaggaagatgaagaatattcttgtgattctcggagtctctttgagagttctgcaaagattcaagtgtgtatacctgagtctatatatcaaaaagtaatggagataaatagagaagtagaagagcctcctaagaagccatctgccttcaagcctgccattgaaatgcaaaactctgttccaaataaagcctttgaattgaagaatgaacaaacattgagagcagatccgatgttcccaccagaatccaaacaaaaggactatgaagaaaattcttgggattctgagagtctctgtgagactgtttcacagaaggatgtgtgtttacccaaggctacacatcaaaaagaaatagataaaataaatggaaaattagaagagtctcctaataaagatggtcttctgaaggctacctgcggaatgaaagtttctattccaactaaagccttagaattgaaggacatgcaaactttcaaagcagagcctccggggaagccatctgccttcgagcctgccactgaaatgcaaaagtctgtcccaaataaagccttggaattgaaaaatgaacaaacattgagagcagatgagatactcccatcagaatccaaacaaaaggactatgaagaaaattcttgggatactgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacgcatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagattcaactagcctatcaaaaatcttggatacagttcattcttgtgaaagagcaagggaacttcaaaaagatcactgtgaacaacgtacaggaaaaatggaacaaatgaaaaagaagttttgtgtactgaaaaagaaactgtcagaagcaaaagaaataaaatcacagttagagaaccaaaaagttaaatgggaacaagagctctgcagtgtgagattgactttaaaccaagaagaagagaagagaagaaatgccgatatattaaatgaaaaaattagggaagaattaggaagaatcgaagagcagcataggaaagagttagaagtgaaacaacaacttgaacaggctctcagaatacaagatatagaattgaagagtgtagaaagtaatttgaatcaggtttctcacactcatgaaaatgaaaattatctcttacatgaaaattgcatgttgaaaaaggaaattgccatgctaaaactggaaatagccacactgaaacaccaataccaggaaaaggaaaataaatactttgaggacattaagattttaaaagaaaagaatgctgaacttcagatgaccctaaaactgaaagaggaatcattaactaaaagggcatctcaatatagtgggcagcttaaagttctgatagctgagaacacaatgctcacttctaaattgaaggaaaaacaagacaaagaaatactagaggcagaaattgaatcacaccatcctagactggcttctgctgtacaagaccatgatcaaattgtgacatcaagaaaaagtcaagaacctgctttccacattgcaggagatgcttgtttgcaaagaaaaatgaatgttgatgtgagtagtacgatatataacaatgaggtgctccatcaaccactttctgaagctcaaaggaaatccaaaagcctaaaaattaatctcaattatgcaggagatgctctaagagaaaatacattggtttcagaacatgcacaaagagaccaacgtgaaacacagtgtcaaatgaaggaagctgaacacatgtatcaaaacgaacaagataatgtgaacaaacacactgaacagcaggagtctctagatcagaaattatttcaactacaaagcaaaaatatgtggcttcaacagcaattagttcatgcacataagaaagctgacaacaaaagcaagataacaattgatattcattttcttgagaggaaaatgcaacatcatctcctaaaagagaaaaatgaggagatatttaattacaataaccatttaaaaaaccgtatatatcaatatgaaaaagagaaagcagaaacagaaaactcatga

SEQ ID NO: 7249 - DNA, 2665 bp, synthetic construct
  misc_feature 1..2665: note = Synthetic polypeptide
  source 1..2665: mol_type = other DNA
tttggtgccgtgacttggatcagggacctcccttgggagatcaatcccctgtcctcctgctctttgctctgtgagaaagatccacctacgacctcaggtcctcagaccgaccagcccaagaaacatctcaccaatttcaaatccggtaagcggcctctttttactgtcttctccaacctccctcactatccgtcaacctctttctcctttcaatcttggcgccacactgcagtctctcccttctcttaatttcaattcctttcattttctggtagagacaaaggagacatgttttatccgtggacccaaaactctggcgccggtcacggactgggaaggcagccttcccttggtgtttaatcattgcagggatgcctctctgattatctacccacgtttcaagagtgtcagaccacgcagggaagcctgccttggtccttcacccttagtggcaagtcccgcttttctggggaaggggcaagtacgccaacaccttctctccttgtctctaccccttctctgcttttgtggggaaagggcaagtaccccaaccccttctctccttgtctctaccccttctctgcttttctgggggaggggcaagtacccctcaaccccttctccttcacccttagcggcaagtcccgcttttctgggggaggggcaagcacccctcaacaccttctccttcacccttggtggcaagtccctcttttctatggggcaagaacccccaatcccttatttctgcaccccgacctcttatctctgtgccccaatcccttatttccatgccccaacctcttatctctatgccccaatcccttatttccgcaccccaacctcttatctctgtgccccaatcccttatttccatgccccaacctcttatctctatgccccaatcccttatttctgcaccccaacctcttatctctgtgccccaatcccttatttccacaccccaacctcttatctctgtgccccaatcccttatttccgtgccctgacccccctccctgcttttctggagggtaagaacccccaaatcccttccctccgtgtctctacactctcttttctctaggtttgcctccttcactatgggcaaccttccaccctccattcctccttcttctcccttagcctgtgttcttaagaacttaaaacctcttcaactctcacctgacctaaaatctaagtgtcttattttcttctgcaatgccgtttgaccccagtacaaactcaacagtagttccaaatagccggaaaatggcactttcaatttttccatcctacaagatctgaataattcttgtcgtaaaataggcaaatggtctgaggtgcctgacgtccaggcattattttacacatcagtcccttcctagtctctgtgcccagtgcaactcatcccaaatcttccttccttcccgcctgtcccctcagtcccaaccccaagcgtcgctgagtctttctaatcttccttttctacagacccatctgacctctcccctcctcgccaggccaagctaggtcccaattcttcctcagcctccactcctccaccctgtaatctttttatcgcctcccctcctcacacctggtccagcttacggtttaattccatgactagccctcccccacctgcccagcaatttactcttaaaaaggtggctggagccaaaggcatagtcgaggttaatgctcctttttctttaccccaaatcagaagggtttaggctctttttcatcagatataaaaacccagcccagttcatggctcgttcagcagcaaccctgagacgctttacagccctagaccctaaaaggtcaaaaggccatcttattctcaatatacattttattacccaatctgctcccaacattaaactccaaaaattagaatctggccctcaaaccccgcaacaggacttaacctcaccttcaaggtgtacaataataaaaaaaaaagtggcaattccttgcctccactgtgagacaaaccccagccacatctccagcacacaagaacttccaaacgcctaaaccgaagtgcccaggcgttcctccagaacctcctcccccaggagcttgctacaagtgccagaaatctgaccaccaggccaaggaatgcctgcagcccaggattcctcctaagccgtgtcccatctgtgcggggaccccactggaaattggactgttcaactcacctggcagccactcccagagcccctggaactctggcccaaggctctctgactgactccttggcttagcggctgaagactgatgctgcccgatcgcctcagaagccccctagaccatcacggatgccgagcttcgggtaactctcacagtggaaggactattccctgatataaccaggccctttaaaaagtcatttgatgtcaagcatggagtggcacatcaaatttgggattttggtgattgttttccgacacctccaaattatggaaaatactgtgtgagacctaaaaagccagcacaggaggccctgataaactacagtcgacgagggaaaggtgtcctaaagcatcttcatggacggtgcgattctgaaagcaaggtttgctcatctgaggattcagaagctgatcgatactccgattatggctggggaggaccctcatcgccatttaactga

SEQ ID NO: 7250 - DNA, 1238 bp, synthetic construct
  misc_feature 1..1238: note = Synthetic polypeptide
  source 1..1238: mol_type = other DNA
ctcgccttcaggacttgggctctgtgaaggagaaatgcccgaagctacacagcggacctgtcagagccagcccacaactagggctttctggtacacagtcagtgctgacagttgcttgtgaacaaactgaagttctgctttttgaccctatatcttcaaagcacataaaaacactttctgaagctcatgaagactgtgtaaataatatcagatttcttgataaccggctgtttgctacctgctctgatgacactacaatagcactatgggatctgagaaaattgaacaccaaagtatgcactttacatggtcacactagctgggtgaagaacatcgaatatgatactaatacaagactcttagtaacatcaggatttgatggaaatgtcattatttgggacactaacaggtatacagaagatgggtgtccacataagaaattctttcacacacgttttctcatgcgaatgaggttaacaccagattgttccaaaatgttgatttcaacgtcctctggatatctcttaattttgcatgaccttgacttaactaagtctttagaagtaggcagctatcccattttaagagcaagaagaactacttcaagttcagatttgaccacttcatcaagttcatctggtcctagagtttctggctcaccttgtcatcatagtgattctaattcttctgagaaacacatgtcacgagcctctcaaagagaaggagtttcaccacgaaatagtcttgaagtcgtaacccctgaagttcttggtgagagtgaccacggaaactgcatcacgtccttacagctgcacccaaaaggctgggccactcttcttcggtgctcaagcaacagtgatgatgaggagtgtacttgtgtctatgaattccaagaaggagctccagtgcgacctgtctcacctcgctgttctctacgactgactcattacattgaagaagccaatgtaggcaggggttacatcaaagaactttgcttcagccccgatggacgaatgatttcttccccacatggctatgggattcgcttgttgggatttgacaaacagtgcagtgaacttgttgactgcttgcccaaagaagccagtcccctgcgggtgatccgttctctgtactctcataatgatgtggtactgacaacaaagttctctccaacacattgtcagattgcctcagggtgccttagtggacgggtttctttgtatcagccaaagttttag

SEQ ID NO: 7251 - DNA, 1127 bp, synthetic construct
  misc_feature 1..1127: note = Synthetic polypeptide
  source 1..1127: mol_type = other DNA
ctcgccttcaggacttgggctctgtgaaggagaaatgcccgaagctacacagcggacctgtcagagccagcccacaactagggctttctggtacacagtcagtgctgacagttgcttgtgaacaaactgaagttctgctttttgaccctatatcttcaaagcacataaaaacactttctgaagctcatgaagactgtgtaaataatatcagatttcttgataaccggctgtttgctacctgctctgatgacactacaatagcactatgggatctgagaaaattgaacaccaaagtatgcactttacatggtcacactagctgggtgaagaacatcgaatatgatactaatacaagactcttagtaacatcaggatttgatggaaatgtcattatttgggacactaacaggtatacagaagatgggtgtccacataagaaattctttcacacacgttttctcatgcgaatgaggttaacaccagattgttccaaaatgttgatttcaacgtcctctggatatctcttaattttgcatgaccttgacttaactaagtctttagaagtaggcagctatcccattttaagagcaagaagaactacttcaagttcaggagtttcaccacgaaatagtcttgaagtcgtaacccctgaagttcttggtgagagtgaccacggaaactgcatcacgtccttacagctgcacccaaaaggctgggccactcttcttcggtgctcaagcaacagtgatgatgaggagtgtacttgtgtctatgaattccaagaaggagctccagtgcgacctgtctcacctcgctgttctctacgactgactcattacattgaagaagccaatgtaggcaggggttacatcaaagaactttgcttcagccccgatggacgaatgatttcttccccacatggctatgggattcgcttgttgggatttgacaaacagtgcagtgaacttgttgactgcttgcccaaagaagccagtcccctgcgggtgatccgttctctgtactctcataatgatgtggtactgacaacaaagttctctccaacacattgtcagattgcctcagggtgccttagtggacgggtttctttgtatcagccaaagttttag

SEQ ID NO: 7252 - DNA, 834 bp, synthetic construct
  misc_feature 1..834: note = Synthetic polypeptide
  source 1..834: mol_type = other DNA
cttgagtgtgggctggatttattgactttattctaaatatacagtgatgaaaagggataaaaggtgcagaactctggcagacactactataaccagttattcaaggttaatatcaccatcaataagtccgttgctataatatgccctatgacatgatgtgatgagaaaggcatttcttctttgtggtatttgtcccaaatatccataaccccagtataattatcagaaaagcataacacaaacttgacctgagggacattctacgaaatacttaaccagggcccctgaaaactgtcagggtcacaggaaataagaaaagtctgagaaactcttacagcccagaggagactaaggagacatggcaaataagtgtactgacacaccctggaaaggaacagaaagagaacattattagaaaagctgatgaaatccaaataggctggagtttagttagtagtatcataccaatgttggcttcttagttgtgacagatgtaccactatgaggtaagatgttaacaacagcagaaactggattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggactatgatgccttctttgaagccagagaaaataatgcagtgtatgccttcttaggcttgacagccccacctggttcaaaggaagcagaagtgcaagcaaagcagcaagcatga

SEQ ID NO: 7253 - DNA, 936 bp, synthetic construct
  misc_feature 1..936: note = Synthetic polypeptide
  source 1..936: mol_type = other DNA
ggagagctgttggcgatttaggggacagcggggacaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaa

SEQ ID NO: 7254 - DNA, 840 bp, synthetic construct
  misc_feature 1..840: note = Synthetic polypeptide
  source 1..840: mol_type = other DNA
ggagagctgttggcgatttaggggacagcggggacaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggtaccgaacaaccctcctgctcacatgtcccccagggtttggggctcctctgtcccccgtcccgtga

SEQ ID NO: 7255 - DNA, 69 bp, synthetic construct
  misc_feature 1..69: note = Synthetic polypeptide
  source 1..69: mol_type = other DNA
ggagagctgttggcgatttaggggacagcggggacaggcccctccagccagcgtcaggtgcagaatggc

SEQ ID NO: 7256 - DNA, 229 bp, synthetic construct
  misc_feature 1..229: note = Synthetic polypeptide
  source 1..229: mol_type = other DNA
ggagagctgttggcgatttaggggacagcggggacaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggc

SEQ ID NO: 7257 - DNA, 643 bp, synthetic construct
  misc_feature 1..643: note = Synthetic polypeptide
  source 1..643: mol_type = other DNA
ggagagctgttggcgatttaggggacagcggggacaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcag

SEQ ID NO: 7258 - DNA, 959 bp, synthetic construct
  misc_feature 1..959: note = Synthetic polypeptide
  source 1..959: mol_type = other DNA
ccttgcagattaaggtgtggtccctggaccatgcccaacggcataggcagcacttgaaaactggctaaaaacgcagactctcaggccccgggccagagctactgaatcaaaatctgcattttaacaaggttcccaggtttctttttggagacaggcccttttggtgggtccatgagtctggttactacagccaggctccagcccaggttcaccagttcccctcttcttgtgagactggtccaggcagcccttctggacactgcatgatcacaggagcagccctctggcccataatgacggccctgtcttcgcaggtggccactcgggcccgcagccgctgggtaagggtgatgcctagcctggcttattgcaccttccttttggcggttggcttgtcgcgaatcttcatcttagcacatttccctcaccaggtgctggctggcctaataactggcgctgtcctgggctggctgatgactccccgagtgcctatggagcgggagctaagcttctatgggttgactgcactggccctcatgctaggcaccagcctcatctattggaccctctttacactgggcctggatctttcttggtccatcagcctagccttcaagtggtgtgagcggcctgagtggatacacgtggatagccggccctttgcctccctgagccgtgactcaggggctgccctgggcctgggcattgccttgcactctccctgctatgcccaggtgcgtcgggcacagctgggaaatggccagaagatagcctgccttgtgctggccatggggctgctgggccccctggactggctgggccacccccctcagatcagcctcttctacattttcaatttcctcaagtacaccctctggccatgcctagtcctggccctcgtgccctgggcagtgcacatgttcagtgcccaggaagcaccgcccatccactcttcctga

SEQ ID NO: 7259 - DNA, 649 bp, synthetic construct
  misc_feature 1..649: note = Synthetic polypeptide
  source 1..649: mol_type = other DNA
ccttgcagattaaggtgtggtccctggaccatgcccaacggcataggcagcacttgaaaactggctaaaaacgcagactctcaggccccgggccagagctactgaatcaaaatctgcattttaacaaggttcccaggtttctttttggagacaggcccttttggtgggtccatgagtctggttactacagccaggctccagcccaggtggccactcgggcccgcagccgctgggtaagggtgatgcctagcctggcttattgcaccttccttttggcggttggcttgtcgcgaatcttcatcttagcacatttccctcaccaggtgctggctggcctaataactggcgctgtcctgggctggctgatgactccccgagtgcctatggagcgggagctaagcttctatgggttgactgcactggccctcatgctaggcaccagcctcatctattggaccctctttacactgggcctggatctttcttggtccatcagcctagccttcaagtggtgtgagcggcctgagtggatacacgtggatagccggccctttgcctccctgagccgtgactcaggggctgccctgggcctgggcattgccttgcactctccctgctatgcccaggtgcgtcgggcacagctgggaaa

SEQ ID NO: 7260 - DNA, 761 bp, synthetic construct
  misc_feature 1..761: note = Synthetic polypeptide
  source 1..761: mol_type = other DNA
ggccaggtgcggtggctcgcgcttacattcctagcactttgggaggccaaggcgggcggatcacctgaggtcaggcgttggagaccagcctagccaacatgatgaaacctcgtctctactaaaaatacaaaaaattagctgggcgtggtggtgcgtgcttgtagtcccagacactccggaggtgaggcgggagaatcgcttgagcccgggaggtggaggttgcagtaagccaacaccgtgccactgcactacagcctgggcgacagggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaagtgtgcccagctggctggaaacctggcagtgataccatcaagcctgatgtccaaaagagcaaagaatatttctccaagcagaagtga

SEQ ID NO: 7261 - DNA, 675 bp, synthetic construct
  misc_feature 1..675: note = Synthetic polypeptide
  source 1..675: mol_type = other DNA
ggccaggtgcggtggctcgcgcttacattcctagcactttgggaggccaaggcgggcggatcacctgaggtcaggcgttggagaccagcctagccaacatgatgaaacctcgtctctactaaaaatacaaaaaattagctgggcgtggtggtgcgtgcttgtagtcccagacactccggaggtgaggcgggagaatcgcttgagcccgggaggtggaggttgcagtaagccaacaccgtgccactgcactacagcctgggcgacagggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaag

SEQ ID NO: 7262 - DNA, 2534 bp, synthetic construct; identical to SEQ ID NO: 586
  misc_feature 1..2534: note = Synthetic polypeptide
  source 1..2534: mol_type = other DNA

SEQ ID NO: 7263 - DNA, 2045 bp, synthetic construct
  misc_feature 1..2045: note = Synthetic polypeptide
  source 1..2045: mol_type = other DNA
taatatgtttcagctgtgctcccacccaaactctcatcttgaattgtaatcatcataagccccacatgtgaagggagagagcaggttgagctaattgaatcatgggggaagtttccccatgctgttctcctgagagtgagtgagctctcacgagatctgatggttttataagtgtttgatggttcctcctgcgtttattctcctttctgctgccttgtgaagaagatgtcttgcttccccttcaccttctaccacaactataagtttcctgaggcctccccagccatgctgaattgctgtcatcaaccggccattcaatgacacctcaaagtgatttggactccagtagctctgaagaattctatcaagctgttcatcatgctgagcaaaccttcagaaagatggaaagttatttgaagcagcagcaactttgtgatgttatcctgattgttgggaaccgaaagatacctgcacataggcttgttctgagttcagtctccgactattttgcggccatgtttacaagtgatgtttgtgaagccaagcaagaggagatcaaaatggaaggcatagaccccaatgctctctgggaccttgtccaatttgcatatacaggctgcttggaattaaaagaggacaccattgagaaccttcttgctgcagcgtgccttcttcagcttccacaggtggtggaagtgtgctgccacttcctcatgaagcttttgcatccatctaactgtttaggaattcgagccttcgcagatgctcaaggatgcattgagttaatgaaggtggcccacagctacacaatggaaaacataatggaagttatcagaaatcaagagtttttactccttccagctgaggagctccataaactactggccagtgatgatgtcaatgttcctgatgaagaaaccatcttccatgcattgatgatgtgggtcaagtatgacatgcagagtagatgcaatgacctgagcatgcttcttgcctttataagactgccactgcttccaccacagatattggctgacctagaaaatcatgcattatttaagaatgatctggaatgtcaaaagctgattctagaagcaatgaaataccatctattgccagaaagaagaactttaatgcaaagtccgagaactaaacccagaaaatctacagtcggaactttgtatgctgtaggaggaatggataacaacaaaggagctacaactatagagaaatatgatctgagaacaaatctgtggatccaggcagggatgatgaatggcagaaggctgcagtttggtgtggctgttattgatgacaaactctttgtaattggaggtcgagatggcttaaagacattgaacactgttgaatgttacaatcccaaaaccaagacatggactgtcttaccaccaatgtcaacacacagacatggtctaggtgtaacagtacttgaaggccctatttatgctgtgggaggccatgatggctggagctatctgaatacagtggaaaggtgggatccacagagtcaacaatggacatttgtagccagtatgtcaattgctcggagcacagttggtgtagcagcattgaatggcaagttgtattcagttggaggtcgtgatggaagttcctgtttgagttcaatggaatattatgatcctcatacaaataagtggaacatgtgtgctcccatgtgtaagaggagagggggtgtcggagtggccacatgtgacggttttctttatgcagtaggaggtcatgatgctcctgcttcaaatcactgttcccggctactggattatgtagaaagatatgatcccaaaacagacacttggaccatggtggctcctttgagtatgcccagagatgctgttggggtctgtctccttggtgacagattatatgctgttggtggctatgatggacagacatacctcaacactatggaatcctatgacccacaaactaatgagtggacacagatggcttccttgaatattgggagagcaggtgcctgtgtggtagtcatcaagcaaccttga

SEQ ID NO: 7264 - DNA, 1720 bp, synthetic construct
  misc_feature 1..1720: note = Synthetic polypeptide
  source 1..1720: mol_type = other DNA
gagggtgtcagaagcgggatctgaagtggagcttctagcgaccccaggagccctgagtgaatatgcaaggcacctgcaggacccactggtgtccattgatctctcagagcgctggagatcgtggcattgcactttgactatggaaacagaggctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaagatgagatcaggggccatgatgagggtagcagcctagaagaacccctaattgagagcagcgaggtggctgacaacaggaaagtccaggagcttcaaggcgagggaggaatccggcttccgaatggtaaactgaaatgtgacgtctgtggcatggtttgcattgggcccaatgtgcttatggtacataaaaggagtcacactggtgaacgccccttccactgtaaccagtgtggagcttcttttactcagaagggcaaccttctgagacacataaagttacactctggagagaagccgttcaaatgtcctttctgtagctacgcctgtagaagaagggacgccctcacaggacacctcaggacccattctgtgggtaaacctcacaagtgcaactactgtggacgaagctacaagcagcgcagttcactggaggagcacaaggaacgctgccacaactatctccagaatgtcagcatggaggctgctgggcaggtcatgagtcaccatgtacctcctatggaagattgtaaggaacaagagcctattatggacaacaatatttctctggtgccttttgagagacctgctgtcatagagaagctcacggggaatatgggaaaacgtaaaagctccactccacaaaagtttgtgggggaaaagctcatgcgattcagctacccagatattcactttgatatgaacttaacatatgagaaggaggctgagctgatgcagtctcatatgatggaccaagccatcaacaatgcaatcacctaccttggagctgaggcccttcaccctctgatgcagcacccgccaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactag

SEQ ID NO: 7265 - DNA, 498 bp, synthetic construct
  misc_feature 1..498: note = Synthetic polypeptide
  source 1..498: mol_type = other DNA
gagggtgtcagaagcgggatctgaagtggagcttctagcgaccccaggagccctgagtgaatatgcaaggcacctgcaggacccactggtgtccattgatctctcagagcgctggagatcgtggcattgcactttgactatggaaacagaggctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaagatgagatcaggggccatgatgagggtagcagcctagaagaacccctaattgagagcagcgaggtggctgacaacaggaaagtccaggagcttcaaggcgagggaggaatccggcttccgaatggtgaacgccccttccactgtaaccagtgtgg

SEQ ID NO: 7266 - DNA, 400 bp, synthetic construct
  misc_feature 1..400: note = Synthetic polypeptide
  source 1..400: mol_type = other DNA
gagggtgtcagaagcgggatctgaagtggagcttctagcgaccccaggagccctgagtgaatatgcaaggcacctgcaggacccactggtgtccattgatctctcagagcgctggagatcgtggcattgcactttgactatggaaacagaggctattgatggctatataacgtgtgacaatgagctttcacccgaaagggagcactccaatatggcaattgacctcacctcaagcacacccaatggacagcatgcctcaccaagtcacatgacaagcagtaagtcttcattttatgatttttttttgtgtgtgtgtgtctctccagcaacagactttaatttgttaggtctgtggggtcctctcacattgtggtatagctactgttatagattttgctaa

SEQ ID NO: 7267 - DNA, 1694 bp, synthetic construct
  misc_feature 1..1694: note = Synthetic polypeptide
  source 1..1694: mol_type = other DNA
tttaaaaaaaactgaatccatgtaaaacaagtatttatatgcatgagttcataatactaaggagaaaaaaaaatcattacttactttcagagaatgctaatgaatagaattcgttattgttgaaaactgacaaaggaaaagaatcaagcacttgttctgcttttattataaatcagaacttcagagtaatcaaatggccgacaaggtgaattttctctttacagatgtattccagttaataaacagaggtctgataaagacatgtcatcactttgcaaccaccaagaaaaaaatgcatgtaggcaatgagcatccattttgagagcatcacagaaaggcattacatactttttgagagggagtgcctttccatccacatcggtcaagctggcatccagattggggacgcctgctgggaactctattgcctggaacatggaatccagccaaatggcgttgttcttgacactcaacaggatcagctggaaaatgcaaaaatggagcacacaaatgcatctttcgataccttcttctgtgagacaagagctgggaagcatgtgcctagagcactcttcgtggacttggagccaactgttatagatgggatccggacgggccagcaccgttcactcttccaccccgagcagctccttagcggaaaggaggatgctgctaacaattacgcgcgaggccgttactctgtggggtcggaggtcatcgaccttgtgctggagaggacccggaagctggcagaacagtgtggtggacttcagggatttttgattttccgaagctttggaggaggcactggttcagggtttacgtctctcttaatggagaggctcacaggagaatatagcagaaagactaagctggagttctcggtctacccagcccccaggatctccactgctgtggtagagccttataactctgtcctcaccacccactccaccacagagcacacggactgtaccttcatggtggacaacgaggccgtctatgatatatgccatcgtaaactcggtgttgaatgcccctctcatgccagcatcaatagattggtggttcaggtggtatcttccatcactgcctccctccggtttgaagggcccttgaatgtagacctaattgaattccagaccaacctggtaccttatccgagaatacatttccccatgacagccttcgcccccatcgtctctgctgacaaagcctaccatgagcagttctctgtgtcagacatcaccactgcctgctttgagtcctccaaccagctggtcaagtgtgatcctcggcttgggaagtacatggcctgctgcctactctatagaggggatgtggtccccaaggaagtgaatgcagcaatcgcagccacgaagtcgaggcactctgttcagtttgtagattggtgtccaactggtttcaaggtgggcatcaacaatcggccgcccacggtgatgccgggtggggacctggccaaagtccaccggtccatctgcatgctgagcaacaccacggcgattgtggaggcctgggcccgcctggaccacaagtttgacctcatgtacgccaagagagcatttctgcactggtacctcagagaaggcatggaagaagcagagttcttggaggccagggaagatctggcagccctggagagggactatgaggaagtggcgcaaagtttctga

SEQ ID NO: 7268 - DNA, 1163 bp, synthetic construct
  misc_feature 1..1163: note = Synthetic polypeptide
  source 1..1163: mol_type = other DNA
ttcttctctccagcagccagaacagcctgtagctctttacaagcactgtgctctttcccatcttgaaggctttgctcccgctgcttcctctttgtgcagttacctctcttccactggataacagtcactcatcctttaagattcagttcaatgatgacttctttctggaagcctcttctgagccagccaccagactaggttgggtgttcctcttctgtgtcccatagtaccagtgtttacttctaatatttcataattgtctgataatggatctgccttaccagttctgcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataa

SEQ ID NO: 7269 - DNA, 893 bp, synthetic construct
  misc_feature 1..893: note = Synthetic polypeptide
  source 1..893: mol_type = other DNA
ttcttctctccagcagccagaacagcctgtagctctttacaagcactgtgctctttcccatcttgaaggctttgctcccgctgcttcctctttgtgcagttacctctcttccactggataacagtcactcatcctttaagattcagttcaatgatgacttctttctggaagcctcttctgagccagccaccagactaggttgggtgttcctcttctgtgtcccatagtaccagtgtttacttctaatatttcataattgtctgataatggatctgccttaccagttctgcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgcattatgtatacatatacacgtcatatctga

SEQ ID NO: 7270 - DNA, 1235 bp, synthetic construct
  misc_feature 1..1235: note = Synthetic polypeptide
  source 1..1235: mol_type = other DNA
ttcttctctccagcagccagaacagcctgtagctctttacaagcactgtgctctttcccatcttgaaggctttgctcccgctgcttcctctttgtgcagttacctctcttccactggataacagtcactcatcctttaagattcagttcaatgatgacttctttctggaagcctcttctgagccagccaccagactaggttgggtgttcctcttctgtgtcccatagtaccagtgtttacttctaatatttcataattgtctgataatggatctgccttaccagttctgcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatgcattatgtatacatatacacgtcatatctgactatggacgaacggtttattctgtgacagtcatacatctctgcagtcaaagaaaccgaggctcaaagaaattaggaaacagctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatat

SEQ ID NO: 7271 - DNA, 392 bp, synthetic construct
  misc_feature 1..392: note = Synthetic polypeptide
  source 1..392: mol_type = other DNA
ttcttctctccagcagccagaacagcctgtagctctttacaagcactgtgctctttcccatcttgaaggctttgctcccgctgcttcctctttgtgcagttacctctcttccactggataacagtcactcatcctttaagattcagttcaatgatgacttctttctggaagcctcttctgagccagccaccagactaggttgggtgttcctcttctgtgtcccatagtaccagtgtttacttctaatatttcataattgtctgataatggatctgccttaccagttctgcgatattggtatcaacttgactgaccctatgttcagaggaatttataggggggttcaaaagcatcaagtttatgattacaggtggaaatctacaagacagtaa

SEQ ID NO: 7272 - DNA, 902 bp, synthetic construct
  misc_feature 1..902: note = Synthetic polypeptide
  source 1..902: mol_type = other DNA
ttcttctctccagcagccagaacagcctgtagctctttacaagcactgtgctctttcccatcttgaaggctttgctcccgctgcttcctctttgtgcagttacctctcttccactggataacagtcactcatcctttaagattcagttcaatgatgacttctttctggaagcctcttctgagccagccaccagactaggttgggtgttcctcttctgtgtcccatagtaccagtgtttacttctaatatttcataattgtctgataatggatctgccttaccagttctgcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttggtacgttcttaggttgctttggtttttaacttttatttaa

SEQ ID NO: 7273 - DNA, 785 bp, synthetic construct
  misc_feature 1..785: note = Synthetic polypeptide
  source 1..785: mol_type = other DNA
ttcttctctccagcagccagaacagcctgtagctctttacaagcactgtgctctttcccatcttgaaggctttgctcccgctgcttcctctttgtgcagttacctctcttccactggataacagtcactcatcctttaagattcagttcaatgatgacttctttctggaagcctcttctgagccagccaccagactaggttgggtgttcctcttctgtgtcccatagtaccagtgtttacttctaatatttcataattgtctgataatggatctgccttaccagttctgcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtg

SEQ ID NO: 7274 - DNA, 1401 bp, synthetic construct
  misc_feature 1..1401: note = Synthetic polypeptide
  source 1..1401: mol_type = other DNA
ggaggtggatctgcccaccatagacctttggcagtatctgaagatctttagtagtcgcggctagggggctgctgctggcataggataatccaggcacatggcggcactgttgaccccaccttcacgagtcgatgcacgcaccttctctgtgagagtcaagtcagcagcgcgtatgcacaggcaataagagaaagaaagagatgtgttactgcacactggttaaacacagtcttaaagaagaagaaaatggtaccgccgcaccgagcccttcacttcccagtggccttcccaccaggaggaaagccatgttcacagcatattatttctgtgactggatttgttgatagtgacagagatgacctaaaattaatggcttatttggcaggtgccaaatatacgggttatctatgccgcagcaacacagtcctcatctgtaaagaaccaactggtttaaagtatgaaaaagccaaagagtggaggataccctgtgtcaacgcccagtggcttggcgacattcttctgggaaactttgaggcactgaggcagattcagtatagtcgctacacggcattcagtctgcaggatccatttgcccctacccagcatttagttttaaatcttttagatgcttggagagttcccttaaaagtgtctgcagagttgttgatgagtataagactacctcccaaactgaaacagaatgaagtagctaatgtccagccttcttccaaaagagccagaattgaagacgtaccacctcccactaaaaagctaactccagaattgaccccttttgtgcttttcactggattcgagcctgtccaggttcaacagtatattaagaagctctacattcttggtggagaggttgcggagtctgcacagaagtgcacacacctcattgccagcaaagtgactcgcaccgtgaagttcctgacggcgatttctgtcgtgaagcacatagtgacgccagagtggctggaagaatgcttcaggtgtcagaagttcattgatgagcagaactacattctccgagatgctgaggcagaagtacttttctctttcagcttggaagaatccttaaaacgggcacacgtttctccactctttaaggcaaaatatttttacatcacacctggaatctgcccaagtctttccactatgaaggcaatcgtagagtgtgcaggaggaaaggtgttatccaagcagccatctttccggaagctcatggagcacaagcagaactcgagtttgtcggaaataattttaatatcctgtgaaaatgaccttcatttatgccgagaatattttgccagaggcatagatgttcacaatgcagagttcgttctgactggagtgctcactcaaacgctggactatgaatcatataagtttaactga

SEQ ID NO: 7275 - DNA, 960 bp, synthetic construct
  misc_feature 1..960: note = Synthetic polypeptide
  source 1..960: mol_type = other DNA
ggccgggcgcagtggctcacacctgtaatcccagcactttgggaggccgaggcgggcggatcatgagaaacttacacatgtccaaaaatgattgagatggagcaggcggaggcccagcttgctgagttagacctgctagccagtatgttccctggtgagaatgagctcatagtgaatgaccagctggctgtagcagaactgaaagattgtattgaaaagaagacaatggaggggcgatcttcaaaagtctactttactatcaatatgaacctggatgtatctgacgaaaaaatggcgatgttttctctggcctgtattcttccctttaaatacccggcagttctgcctgaaattactgtcagatcagtattattgagtagatcccagcagactcagctgaacacagatctgactgcattcctgcaaaaacattgtcatggagatgtttgtatactgaatgccacagagtgggttagagaacacgcctctggctatgtcagcagagatacttcatcttcacccaccacaggaagcacagtccagtcagttgacctcatcttcacgagactctggatctacagccatcatatctataacaaatgcaaaagaaagaatattctagagtgggcaaaggagctttccctgtctgggtttagcatgcctggaaaacctggtgttgtttgtgtggaaggcccacaaagtgcctgtgaagaattctggtcaagactcagaaaattaaactggaagagaattttaattcgccatcgagaagacattccttttgatggtacaaatgatgaaacggaaagacaaaggaaattttccatttttgaagaaaaagtgttcagtgttaatggagccaggggaaaccacatggactttggtcagctctatcagttcttaaacaccaaaggatgtggggatgttttccagatgttctttggtgtagaaggacaatga

SEQ ID NO: 7276 - DNA, 1148 bp, synthetic construct; identical to SEQ ID NO: 436
  misc_feature 1..1148: note = Synthetic polypeptide
  source 1..1148: mol_type = other DNA

SEQ ID NO: 7277 - DNA, 1150 bp, synthetic construct
  misc_feature 1..1150: note = Synthetic polypeptide
  source 1..1150: mol_type = other DNA
tgtctccccagatcatcttctcccattcttctcccactcctaccagatttatgccctccctgctccactggaactgccctggccaacctcaccagtgacctccatgtcgcccaatccaaggtcggtttttgaccttcatctggacctaacagtcgatcacctcctgctcctggaaatgcgcatgcaattcagctttcagaacaccactctcacattagctcccttcccatccaggtcctttgttggtttctcatctgctcaacctctggatgttgttcacaccagtgctctcctctaccagctaaactcacccgagtgatcttgtccggtctcatggctttaaatgccacctataggccatcatttcccaggtttatacctccagcctggactcttccctgaatccagactcataaattcatctaacttctcttggatgtctaatgcacttgtcaagatcagcacgagtccaataactctgttcttccctgcagacctgaccttctacccacatccgtgacagctcctttcttctagctgcccaggccccagcccagaggccctctacacagagacaaggctgcagtttgacgagacagccaagcacctccagaagctggaaagcaccaccagaaaggcagtttgtgcatctgtgaaagacttcaacaagagccaggccatcgagtcagtggaaaggaaaaagcaagagaaaaagcaagaacaagaggacaacttggccgagatcaccaacctcctgcgtggggacctgctctccgagaacccgcagcaggcagccagctccttcgggccccaccgcgtggtccctgaccgctggaagggcatgacccaggagcagctggagcagatccgcctagtccagaagcagcaaatccaggagaagctgaggctccaggaagaaaagcgccagcgagacctggactgggaccggcggaggattcagggggctcgcgccaccctgctgtttgagcggcagcagtggcggcggcagcgcgacctgcgcagagctctggacagcagcaacctcagcctggccaaggagcagcatttgcagaaaaaatatatgaatgaagtctatacaaatcaacccacgggagactatttcacacaatttaatacaggaagtcgataa

SEQ ID NO: 7278 - DNA, 163 bp, synthetic construct; identical to SEQ ID NO: 480
  misc_feature 1..163: note = Synthetic polypeptide
  source 1..163: mol_type = other DNA

SEQ ID NO: 7279 - DNA, 104 bp, synthetic construct; identical to SEQ ID NO: 481
  misc_feature 1..104: note = Synthetic polypeptide
  source 1..104: mol_type = other DNA

SEQ ID NO: 7280 - DNA, 1331 bp, synthetic construct; identical to SEQ ID NO: 550
  misc_feature 1..1331: note = Synthetic polypeptide
  source 1..1331: mol_type = other DNA

SEQ ID NO: 7281 - DNA, 1028 bp, synthetic construct; identical to SEQ ID NO: 551
  misc_feature 1..1028: note = Synthetic polypeptide
  source 1..1028: mol_type = other DNA

SEQ ID NO: 7282 - DNA, 1295 bp, synthetic construct; identical to SEQ ID NO: 553
  misc_feature 1..1295: note = Synthetic polypeptide
  source 1..1295: mol_type = other DNA

SEQ ID NO: 7283 - DNA, 1322 bp, synthetic construct; identical to SEQ ID NO: 554
  misc_feature 1..1322: note = Synthetic polypeptide
  source 1..1322: mol_type = other DNA

SEQ ID NO: 7284 - DNA, 1013 bp, synthetic construct; identical to SEQ ID NO: 555
  misc_feature 1..1013: note = Synthetic polypeptide
  source 1..1013: mol_type = other DNA

SEQ ID NO: 7285 - DNA, 742 bp, synthetic construct; identical to SEQ ID NO: 6357
  misc_feature 1..742: note = Synthetic polypeptide
  source 1..742: mol_type = other DNA

SEQ ID NO: 7286 - DNA, 590 bp, synthetic construct; identical to SEQ ID NO: 6358
  misc_feature 1..590: note = Synthetic polypeptide
  source 1..590: mol_type = other DNA

SEQ ID NO: 7287 - DNA, 577 bp, synthetic construct; identical to SEQ ID NO: 6359
  misc_feature 1..577: note = Synthetic polypeptide
  source 1..577: mol_type = other DNA

SEQ ID NO: 7288 - DNA, 430 bp, synthetic construct; identical to SEQ ID NO: 6360
  misc_feature 1..430: note = Synthetic polypeptide
  source 1..430: mol_type = other DNA

SEQ ID NO: 7289 - DNA, 670 bp, synthetic construct; identical to SEQ ID NO: 6361
  misc_feature 1..670: note = Synthetic polypeptide
  source 1..670: mol_type = other DNA

SEQ ID NO: 7290 - DNA, 665 bp, synthetic construct; identical to SEQ ID NO: 6374
  misc_feature 1..665: note = Synthetic polypeptide
  source 1..665: mol_type = other DNA

SEQ ID NO: 7291 - DNA, 518 bp, synthetic construct; identical to SEQ ID NO: 6375
  misc_feature 1..518: note = Synthetic polypeptide
  source 1..518: mol_type = other DNA

SEQ ID NO: 7292 - DNA, 80 bp, synthetic construct; identical to SEQ ID NO: 6364
  misc_feature 1..80: note = Synthetic polypeptide
  source 1..80: mol_type = other DNA

SEQ ID NO: 7293 - DNA, 217 bp, synthetic construct; identical to SEQ ID NO: 6365
  misc_feature 1..217: note = Synthetic polypeptide
  source 1..217: mol_type = other DNA

SEQ ID NO: 7294 - DNA, 2319 bp, synthetic construct; identical to SEQ ID NO: 6366
  misc_feature 1..2319: note = Synthetic polypeptide
  source 1..2319: mol_type = other DNA

SEQ ID NO: 7295 - DNA, 382 bp, synthetic construct; identical to SEQ ID NO: 434
  misc_feature 1..382: note = Synthetic polypeptide
  source 1..382: mol_type = other DNA

SEQ ID NO: 7296 - DNA, 486 bp, synthetic construct
  misc_feature 1..486: note = Synthetic polypeptide
  source 1..486: mol_type = other DNA
ttgctgctctaagtgtcgcaaaccaggacagcagaattatctgggtggttgttggacgtccagtgtctcatgctggcctaaggatcggaatcggcattttaactacttcccggaggagcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccctgctgtcacttacatctataactgggcctacggctttgggtgggcagccacgattatcctgattggctgtgccttcttcttctgctgcctccccaactacgaagatgaccttctgggcaatgccaagcccaggtacttctacacatctgcctaa

SEQ ID NO: 7297 - DNA, 369 bp, synthetic construct
  misc_feature 1..369: note = Synthetic polypeptide
  source 1..369: mol_type = other DNA
ctggctgggtgttcttcatcaagacaatcatgctgcgtaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataa

SEQ ID NO: 7298 - DNA, 337 bp, synthetic construct; identical to SEQ ID NO: 6393
  misc_feature 1..337: note = Synthetic polypeptide
  source 1..337: mol_type = other DNA

SEQ ID NO: 7299 - DNA, 369 bp, synthetic construct; identical to SEQ ID NO: 6492
  misc_feature 1..369: note = Synthetic polypeptide
  source 1..369: mol_type = other DNA

SEQ ID NO: 7300 - DNA, 1452 bp, synthetic construct
  misc_feature 1..1452: note = Synthetic polypeptide
  source 1..1452: mol_type = other DNA
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggaggtgaggagcgtcgctgcccggccgccccgtctgagaagtgaggagcccctccgcccggcagccgccccgtctgggaagtgaggagcgtctccgcccggcagccaccccgtccgggaaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactga

SEQ ID NO: 7301 - DNA, 1149 bp, synthetic construct
  misc_feature 1..1149: note = Synthetic polypeptide
  source 1..1149: mol_type = other DNA
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggaggtgaggagcgtcgctgcccggccgccccgtctgagaagtgaggagcccctccgcccggcagccgccccgtctgggaagtgaggagcgtctccgcccggcagccaccccgtccgggaaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtttcttcgtttgagtcagtcgccttga

SEQ ID NO: 7302 - DNA, 1416 bp, synthetic construct
  misc_feature 1..1416: note = Synthetic polypeptide
  source 1..1416: mol_type = other DNA
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggaggtgaggagcgtcgctgcccggccgccccgtctgagaagtgaggagcccctccgcccggcagccgccccgtctgggaagtgaggagcgtctccgcccggcagccaccccgtccgggaaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagtcgttccccatcaggaagtcctcgcagaagtgcaagtcctgaaagaatggactga

SEQ ID NO: 7303 - DNA, 1443 bp, synthetic construct
  misc_feature 1..1443: note = Synthetic polypeptide
  source 1..1443: mol_type = other DNA
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggaggtgaggagcgtcgctgcccggccgccccgtctgagaagtgaggagcccctccgcccggcagccgccccgtctgggaagtgaggagcgtctccgcccggcagccaccccgtccgggaaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgagatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactga

SEQ ID NO: 7304 - DNA, 1134 bp, synthetic construct
  misc_feature 1..1134: note = Synthetic polypeptide
  source 1..1134: mol_type = other DNA
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggaggtgaggagcgtcgctgcccggccgccccgtctgagaagtgaggagcccctccgcccggcagccgccccgtctgggaagtgaggagcgtctccgcccggcagccaccccgtccgggaaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtatttattttaa

SEQ ID NO: 7305 - DNA, 540 bp, synthetic construct; identical to SEQ ID NO: 6513
  misc_feature 1..540: note = Synthetic polypeptide
  source 1..540: mol_type = other DNA

SEQ ID NO: 7306 - DNA, 651 bp, synthetic construct; identical to SEQ ID NO: 6514
  misc_feature 1..651: note = Synthetic polypeptide
  source 1..651: mol_type = other DNA

SEQ ID NO: 7307 - DNA, 569 bp, synthetic construct; identical to SEQ ID NO: 6515
  misc_feature 1..569: note = Synthetic polypeptide
  source 1..569: mol_type = other DNA

SEQ ID NO: 7308 - DNA, 152 bp, synthetic construct; identical to SEQ ID NO: 6516
  misc_feature 1..152: note = Synthetic polypeptide
  source 1..152: mol_type = other DNA

SEQ ID NO: 7309 - DNA, 252 bp, synthetic construct
  misc_feature 1..252: note = Synthetic polypeptide
  source 1..252: mol_type = other DNA
ggccaggcacggtggctcacgcctgtaatcccagcactttgggaggccgagacgggcggatcacgaggtcaagagatggagaccatcccggctaacacgttaatccaggaagatattcttgatactggaaatgacaaaaatggaaaggaagaagtcataaagagaaaaattccttatattctgaaacggcagctgtatgagaataaacccagaagaccctacatactcaaaagagattcttactattactga

SEQ ID NO: 7310 - DNA, 1883 bp, synthetic construct; identical to SEQ ID NO: 6345
  misc_feature 1..1883: note = Synthetic polypeptide
  source 1..1883: mol_type = other DNA

SEQ ID NO: 7311 - DNA, 285 bp, synthetic construct; identical to SEQ ID NO: 6477
  misc_feature 1..285: note = Synthetic polypeptide
  source 1..285: mol_type = other DNA

SEQ ID NO: 7312 - DNA, 414 bp, synthetic construct; identical to SEQ ID NO: 6481
  misc_feature 1..414: note = Synthetic polypeptide
  source 1..414: mol_type = other DNA

SEQ ID NO: 7313 - DNA, 871 bp, synthetic construct; identical to SEQ ID NO: 437
  misc_feature 1..871: note = Synthetic polypeptide
  source 1..871: mol_type = other DNA

SEQ ID NO: 7314 - DNA, 421 bp, synthetic construct; identical to SEQ ID NO: 441
  misc_feature 1..421: note = Synthetic polypeptide
  source 1..421: mol_type = other DNA

SEQ ID NO: 7315 - DNA, 638 bp, synthetic construct; identical to SEQ ID NO: 442
  misc_feature 1..638: note = Synthetic polypeptide
  source 1..638: mol_type = other DNA

SEQ ID NO: 7316 - DNA, 337 bp, synthetic construct; identical to SEQ ID NO: 443
  misc_feature 1..337: note = Synthetic polypeptide
  source 1..337: mol_type = other DNA

SEQ ID NO: 7317 - DNA, 2448 bp, synthetic construct; identical to SEQ ID NO: 6618
  misc_feature 1..2448: note = Synthetic polypeptide
  source 1..2448: mol_type = other DNA

SEQ ID NO: 7318 - DNA, 1543 bp, synthetic construct; identical to SEQ ID NO: 6619
  misc_feature 1..1543: note = Synthetic polypeptide
  source 1..1543: mol_type = other DNA

SEQ ID NO: 7319 - DNA, 1468 bp, synthetic construct; identical to SEQ ID NO: 6620
  misc_feature 1..1468: note = Synthetic polypeptide
  source 1..1468: mol_type = other DNA

SEQ ID NO: 7320 - DNA, 2672 bp, synthetic construct; identical to SEQ ID NO: 6621
  misc_feature 1..2672: note = Synthetic polypeptide
  source 1..2672: mol_type = other DNA

SEQ ID NO: 7321 - DNA, 1767 bp, synthetic construct; identical to SEQ ID NO: 6622
  misc_feature 1..1767: note = Synthetic polypeptide
  source 1..1767: mol_type = other DNA

SEQ ID NO: 7322 - DNA, 1692 bp, synthetic construct; identical to SEQ ID NO: 6623
  misc_feature 1..1692: note = Synthetic polypeptide
  source 1..1692: mol_type = other DNA

SEQ ID NO: 7323 - DNA, 483 bp, synthetic construct
  misc_feature 1..483: note = Synthetic polypeptide
  source 1..483: mol_type = other DNA
tagggaagtacctttaaattatatgcctcagtttcctcatctgtaaaattgggataatgagattttctacattttaggttgttgtggggattaagtgaaatacaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaaacgtggtactggaggagtggacactgctgctacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaa

SEQ ID NO: 7324 - DNA, 3021 bp, synthetic construct; identical to SEQ ID NO: 449
  misc_feature 1..3021: note = Synthetic polypeptide
  source 1..3021: mol_type = other DNA

SEQ ID NO: 7325 - DNA, 3075 bp, synthetic construct; identical to SEQ ID NO: 450
  misc_feature 1..3075: note = Synthetic polypeptide
  source 1..3075: mol_type = other DNA

SEQ ID NO: 7326 - DNA, 1143 bp, synthetic construct; identical to SEQ ID NO: 451
  misc_feature 1..1143: note = Synthetic polypeptide
  source 1..1143: mol_type = other DNA

SEQ ID NO: 7327 - DNA, 769 bp, synthetic construct; identical to SEQ ID NO: 6486
  misc_feature 1..769: note = Synthetic polypeptide
  source 1..769: mol_type = other DNA

SEQ ID NO: 7328 - DNA, 365 bp, synthetic construct; identical to SEQ ID NO: 6504
  misc_feature 1..365: note = Synthetic polypeptide
  source 1..365: mol_type = other DNA

SEQ ID NO: 7329 - DNA, 509 bp, synthetic construct; identical to SEQ ID NO: 6505
  misc_feature 1..509: note = Synthetic polypeptide
  source 1..509: mol_type = other DNA

SEQ ID NO: 7330 - DNA, 483 bp, synthetic construct
  misc_feature 1..483: note = Synthetic polypeptide
  source 1..483: mol_type = other DNA
tagggaagtacctttaaattatatgcctcagtttcctcatctgtaaaattgggataatgagattttctacattttaggttgttgtggggattaagtgaaatacaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaagcgtggtactggaggagtggacactgctgccacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaa

SEQ ID NO: 7331 - DNA, 243 bp, synthetic construct; identical to SEQ ID NO: 6494
  misc_feature 1..243: note = Synthetic polypeptide
  source 1..243: mol_type = other DNA

SEQ ID NO: 7332 - DNA, 1133 bp, synthetic construct
  misc_feature 1..1133: note = Synthetic polypeptide
  source 1..1133: mol_type = other DNA
cacctggcctcctgctctctgtccttagatgtctgcggaaacatccctcgtcagaagcgcttgctcagttgtacacatgagcccgagggtcctcagcttttctttccataggttccagaggccgtagtttctttgtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagaatcactatcagtgacccctga

SEQ ID NO: 7333 - DNA, 1172 bp, synthetic construct
  misc_feature 1..1172: note = Synthetic polypeptide
  source 1..1172: mol_type = other DNA
cacctggcctcctgctctctgtccttagatgtctgcggaaacatccctcgtcagaagcgcttgctcagttgtacacatgagcccgagggtcctcagcttttctttccataggttccagaggccgtagtttctttgtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagccgatcgggtcaggcaagtccatcccgtcctgagagccccaggccccccttcgacctctaa

SEQ ID NO: 7334 - DNA, 488 bp, synthetic construct; identical to SEQ ID NO: 6517
  misc_feature 1..488: note = Synthetic polypeptide
  source 1..488: mol_type = other DNA

SEQ ID NO: 7335 - DNA, 299 bp, synthetic construct; identical to SEQ ID NO: 485
  misc_feature 1..299: note = Synthetic polypeptide
  source 1..299: mol_type = other DNA

SEQ ID NO: 7336 - DNA, 545 bp, synthetic construct
  misc_feature 1..545: note = Synthetic polypeptide
  source 1..545: mol_type = other DNA
gtgcttctctaccctggctgcatgttagaaatatcttgggagcttctaaatagtgttgaagttctagctccacttcagactcattaaatcagagctccttgggggtaggatccaggaaggaggagacagttactgtctatcccgcagacgtggtgctctttgaagggatcctggccttctactcccaggaggtacgagacctgttccagatgaagctttttgtggatacagatgcggacacccggctctcacgcagagtattaagggacatcagcgagagaggcagggatcttgagcagattttatctcagtacattacgttcgtcaagcctgcctttgaggaattctgcttgccaacaaagaagtatgctgatgtgatcatccctagaggtgcagataatctggtggccatcaacctcatcgtgcagcacatccaggacatcctgaatggagggccctccaaacggcagaccaatggctgtctcaacggctacaccccttcacgcaagaggcaggcatcggagtccagcagcaggccgcattga

SEQ ID NO: 7337 - DNA, 543 bp, synthetic construct; identical to SEQ ID NO: 6496
  misc_feature 1..543: note = Synthetic polypeptide
  source 1..543: mol_type = other DNA

SEQ ID NO: 7338 - DNA, 378 bp, synthetic construct; identical to SEQ ID NO: 6497
  misc_feature 1..378: note = Synthetic polypeptide
  source 1..378: mol_type = other DNA

SEQ ID NO: 7339 - DNA, 267 bp, synthetic construct; identical to SEQ ID NO: 6498
  misc_feature 1..267: note = Synthetic polypeptide
  source 1..267: mol_type = other DNA

SEQ ID NO: 7340 - DNA, 416 bp, synthetic construct; identical to SEQ ID NO: 6499
  misc_feature 1..416: note = Synthetic polypeptide
  source 1..416: mol_type = other DNA

SEQ ID NO: 7341 - DNA, 162 bp, synthetic construct; identical to SEQ ID NO: 6500
  misc_feature 1..162: note = Synthetic polypeptide
  source 1..162: mol_type = other DNA

SEQ ID NO: 7342 - DNA, 2471 bp, synthetic construct; identical to SEQ ID NO: 576
  misc_feature 1..2471: note = Synthetic polypeptide
  source 1..2471: mol_type = other DNA

SEQ ID NO: 7343 - DNA, 289 bp, synthetic construct
  misc_feature 1..289: note = Synthetic polypeptide
  source 1..289: mol_type = other DNA
ataccttaaagcatccattccatgtaataaattaacttttcttctatttatctagaatgatgatatcaagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtag

SEQ ID NO: 7344 - DNA, 246 bp, synthetic construct
  misc_feature 1..246: note = Synthetic polypeptide
  source 1..246: mol_type = other DNA
ataccttaaagcatccattccatgtaataaattaacttttcttctatttatctagaatgatgatatcaagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttt

SEQ ID NO: 7345 - DNA, 149 bp, synthetic construct
  misc_feature 1..149: note = Synthetic polypeptide
  source 1..149: mol_type = other DNA
ataccttaaagcatccattccatgtaataaattaacttttcttctatttatctagaatgatgatatcaagattaaatctcttgatgaacagtgtgtggttggcaaaatttccaagcactggactggaattttgagagaggcatttacag

SEQ ID NO: 7346 - DNA, 89 bp, synthetic construct
  misc_feature 1..89: note = Synthetic polypeptide
  source 1..89: mol_type = other DNA
ataccttaaagcatccattccatgtaataaattaacttttcttctatttatctagaatgatgatatcaagattaaatctcttgatgaac

SEQ ID NO: 7347 - DNA, 80 bp, synthetic construct
  misc_feature 1..80: note = Synthetic polypeptide
  source 1..80: mol_type = other DNA
ataccttaaagcatccattccatgtaataaattaacttttcttctatttatctagaatgatgatatcaagattaaatctc

SEQ ID NO: 7348 - DNA, 2588 bp, synthetic construct; identical to SEQ ID NO: 6741
  misc_feature 1..2588: note = Synthetic polypeptide
  source 1..2588: mol_type = other DNA

SEQ ID NO: 7349 - DNA, 1964 bp, synthetic construct; identical to SEQ ID NO: 6742
  misc_feature 1..1964: note = Synthetic polypeptide
  source 1..1964: mol_type = other DNA

SEQ ID NO: 7350 - DNA, 2535 bp, synthetic construct; identical to SEQ ID NO: 6677
  misc_feature 1..2535: note = Synthetic polypeptide
  source 1..2535: mol_type = other DNA

SEQ ID NO: 7351 - DNA, 2181 bp, synthetic construct; identical to SEQ ID NO: 6678
  misc_feature 1..2181: note = Synthetic polypeptide
  source 1..2181: mol_type = other DNA

SEQ ID NO: 7352 - DNA, 1119 bp, synthetic construct; identical to SEQ ID NO: 6679
  misc_feature 1..1119: note = Synthetic polypeptide
  source 1..1119: mol_type = other DNA

SEQ ID NO: 7353 - DNA, 1731 bp, synthetic construct; identical to SEQ ID NO: 6691
  misc_feature 1..1731: note = Synthetic polypeptide
  source 1..1731: mol_type = other DNA

SEQ ID NO: 7354 - DNA, 2019 bp, synthetic construct; identical to SEQ ID NO: 6692
  misc_feature 1..2019: note = Synthetic polypeptide
  source 1..2019: mol_type = other DNA

SEQ ID NO: 7355 - DNA, 2043 bp, synthetic construct; identical to SEQ ID NO: 6693
  misc_feature 1..2043: note = Synthetic polypeptide
  source 1..2043: mol_type = other DNA

SEQ ID NO: 7356 - DNA, 554 bp, synthetic construct; identical to SEQ ID NO: 6694
  misc_feature 1..554: note = Synthetic polypeptide
  source 1..554: mol_type = other DNA

SEQ ID NO: 7357 - DNA, 2537 bp, synthetic construct
  misc_feature 1..2537: note = Synthetic polypeptide
  source 1..2537: mol_type = other DNA
aagttaaacatggaatagctatgtgactcagcaattccaaggtaagatgtaaaagaattgaaaagaagcattcaaacaaatacttctacacaaatgttcacagcagcagcagcagcactatttgtaataaccaaaaggtagaaacaagccaagtgttcatcaactgatgagtaggtaaacaaaatgtggtctatccatacaatggaatgttattgtatgaagtgctgatacatgctgtgacatggatcagccttgaaagtatgatgctaaatgaaagacaccagacacgaaagtcacgtgttgtatgatgccatttctatggaatgtccagcataggcaagtccacagatacagagtaaactggtggttttcaaggcctggagagagacggagtggctgcttaatagaccttcaacaagcttgtgggaaagtttagccagtccatctttcacttgaatttaacacaaatactctcagccacaatggaagggaagctggttgtctgggacatacaccgcccaccctcatctgcctccacctttttgggctttccctatatcaagccttgtaaattggttcatttgcagaaagagggtatcacggtacttaccacaattgatagctacattgtcacaggtgacattaaggggaacattaagttctatgatcacaccctgtctattgttaactggtacagtcacttgaaactgggcgccataagaactctgtccttttcaaagaccccagcaactcctcctactgaaaaatcaaactatcctcctgactgcactttaaaaggtgacctttttgtcttaaggaattttatcattggaacatctgatgccgcggtgtaccacttaacaacagatgggaccaaacttgagaagttatttgtagagcccaaggatgccatttgtgccatctcctgccacccatatcaacccctcattgccatcgggagcatctgtgggatgatcaaagtgtggaattatgaaaacaaacaatatcttttcagcagggtttttgagaaggggcttggagtccagagtctgacctacaaccccgaaggagcccttcttggagctggctttacagaggggacagtttacattcttgatgcaatgtctttagaaaatgaaagcccagagcctttcaaatattccagaaccagtgtgactcatataagcttttcccatgactcccagtatatggcaactgctgatagaagttttactgtggctgtttacatgctggtggtcagaaatggacagagggtctgggagtacttagcaagacttcgctctcatcgcaaaagcattcgaagtctcctgtttggggtttacctggacagcaatgagcctagactgctgagccttgggacagacaggctcttgatagagtatgatcttctcaggagctacaaagaccacctggaagtcctggacattcaccacaccgaccagggctgctatcccacctgcatggtctggtacccaccactcaccagggaactcttcctgcttatttgcaacagtggctacaaagtgaagctttttaatgctactaccaaaatgtgcagaaagacgcttctggggccagcttatggttcccctattgagcagacacaagtcctcccagtgagaagcatggcggagctacagaaacgctacttggtgtttattaacagagacaaggtgggacttcagatcttaccagttgacggcaatccacataagacatctgctattgtttgccacccgaacggggtggccggcatggccgtttcctatgatggctgctacgccttcactgcgggagggcacgatcgctcggtggtgcagtggaaaatcaccttaagtgtcctggaggcagcggtttctcttgggggtgaagacttgaccccattctatggtctgctgtctggtggccgggaaggaaaattctacagggagctagaagactacttctactattctcagctccgcagtcaaggcatcgacacaatggagaccagaaaggtgtcagaacacatttgcctgtcagagcttccttttgtcatgagagcaattggcttttacccatctgaagagaagattgatgatatatttaacgaaatcaaatttggtgaatatgtggacactggaaagctaatcgacaagatcaacttaccagatttcctaaaagtgtaccttaaccacaagccaccttttggtaacaccatgagtggcatccacaagagctttgaggtgctcggttataccaactccaaagggaaaaaggccattcgaagagaggacttcctgagactgctcgttactaaaggtgagcatatgacggaggaggagatgttggattgctttgcttcactgtttggcctgaatcccgagggatggaaatccgagcctgcaacctgctccgtcaaaggttcagaaatttgccttgaagaagaacttccagacgaaatcactgcagaaatattcgcgactgaaattcttggcttaaccatttcagaagattccggccaggatggtcagtga

SEQ ID NO: 7358 - DNA, 1913 bp, synthetic construct
  misc_feature 1..1913: note = Synthetic polypeptide
  source 1..1913: mol_type = other DNA
aagttaaacatggaatagctatgtgactcagcaattccaaggtaagatgtaaaagaattgaaaagaagcattcaaacaaatacttctacacaaatgttcacagcagcagcagcagcactatttgtaataaccaaaaggtagaaacaagccaagtgttcatcaactgatgagtaggtaaacaaaatgtggtctatccatacaatggaatgttattgtatgaagtgctgatacatgctgtgacatggatcagccttgaaagtatgatgctaaatgaaagacaccagacacgaaagtcacgtgttgtatgatgccatttctatggaatgtccagcataggcaagtccacagatacagagtaaactggtggttttcaaggcctggagagagacggagtggctgcttaatagaccttcaacaagcttgtgggaaagtttagccagtccatctttcacttgaatttaacacaaatactctcagccacaatggaagggaagctggttgtctgggacatacaccgcccaccctcatctgcctccacctttttgggctttccctatatcaagccttgtaaattggttcatttgcagaaagagggtatcacggtacttaccacaattgatagctacattgtcacaggtgacattaaggggaacattaagttctatgatcacaccctgtctattgttaactggtacagtcacttgaaactgggcgccataagaactctgtccttttcaaagaccccagcaactcctcctactgaaaaatcaaactatcctcctgactgcactttaaaaggtgacctttttgtcttaaggaattttatcattggaacatctgatgccgcggtgtaccacttaacaacagatgggaccaaacttgagaagttatttgtagagcccaaggatgccatttgtgccatctcctgccacccatatcaacccctcattgccatcgggagcatctgtgggatgatcaaagtgtggaattatgaaaacaaacaatatcttttcagcagggtttttgagaaggggcttggagtccagagtctgacctacaaccccgaaggagcccttcttggagctggctttacagaggggacagtttacattcttgatgcaatgtctttagaaaatgaaagcccagagcctttcaaatattccagaaccagtgtgactcatataagcttttcccatgactcccagtatatggcaactgctgatagaagttttactgtggctgtttacatgctggtggtcagaaatggacagagggtctgggagtacttagcaagacttcgctctcatcgcaaaagcattcgaagtctcctgtttggggtttacctggacagcaatgagcctagactgctgagccttgggacagacaggctcttgatagagtatgatcttctcaggagctacaaagaccacctggaagtcctggacattcaccacaccgaccagggctgctatcccacctgcatggtctggtacccaccactcaccagggaactcttcctgcttatttgcaacagtggctacaaagtgaagctttttaatgctactaccaaaatgtgcagaaagacgcttctggggccagcttatggttcccctattgagcagacacaagtcctcccagtgagaagcatggcggagctacagaaacgctacttggtgtttattaacagagacaaggtgggacttcagatcttaccagttgacggcaatccacataagacatctgctattgtttgccacccgaacggggtggccggcatggccgtttcctatgatggctgctacgccttcactgcgggagggcacgatcgctcggtggtgcagtggaaaatcaccttaagccatcctgggagccaggcaccaatattatccccatcagacacatcaagaagctaa

SEQ ID NO: 7359 - DNA, 1022 bp, synthetic construct; identical to SEQ ID NO: 590
  misc_feature 1..1022: note = Synthetic polypeptide
  source 1..1022: mol_type = other DNA

SEQ ID NO: 7360 - DNA, 347 bp, synthetic construct; identical to SEQ ID NO: 591
  misc_feature 1..347: note = Synthetic polypeptide
  source 1..347: mol_type = other DNA

SEQ ID NO: 7361 - DNA, 1109 bp, synthetic construct; identical to SEQ ID NO: 592
  misc_feature 1..1109: note = Synthetic polypeptide
  source 1..1109: mol_type = other DNA

SEQ ID NO: 7362 - DNA, 85 bp, synthetic construct; identical to SEQ ID NO: 601
  misc_feature 1..85: note = Synthetic polypeptide
  source 1..85: mol_type = other DNA

SEQ ID NO: 7363 - DNA, 269 bp, synthetic construct; identical to SEQ ID NO: 600
  misc_feature 1..269: note = Synthetic polypeptide
  source 1..269: mol_type = other DNA

SEQ ID NO: 7364 - DNA, 365 bp, synthetic construct
  misc_feature 1..365: note = Synthetic polypeptide
  source 1..365: mol_type = other DNA
ctggctgggtgttcttcatcaagacaatcatgctgcgagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataa

SEQ ID NO: 7365 - DNA, 1854 bp, synthetic construct; identical to SEQ ID NO: 6613
  misc_feature 1..1854: note = Synthetic polypeptide
  source 1..1854: mol_type = other DNA

SEQ ID NO: 7366 - DNA, 423 bp, synthetic construct; identical to SEQ ID NO: 6550
  misc_feature 1..423: note = Synthetic polypeptide
  source 1..423: mol_type = other DNA

SEQ ID NO: 7367 - DNA, 1636 bp, synthetic construct; identical to SEQ ID NO: 531
  misc_feature 1..1636: note = Synthetic polypeptide
  source 1..1636: mol_type = other DNA

SEQ ID NO: 7368 - DNA, 1328 bp, synthetic construct; identical to SEQ ID NO: 532
  misc_feature 1..1328: note = Synthetic polypeptide
  source 1..1328: mol_type = other DNA

SEQ ID NO: 7369 - DNA, 2053 bp, synthetic construct
  misc_feature 1..2053: note = Synthetic polypeptide
  source 1..2053: mol_type = other DNA
ggctgggcgcggtggctcacacctgcaatcccagcactttgggacgccgaggcgggtggatcacctaaggtcgagagttcaagaccaggctgaccattatggagaaaccccgtctctactaaaaatacagaaaattagctggataactaagaaattcgtcaaaggctctacagagaagaacaagctcagactgcaaagagatcaggagcgtctgggcaagcagctcaagttacgtgcagaaagggaagaaaaggagaagctgaaagaggaggccaagcgggccaaggaggaggccaagaagaagaaggaggaagagaaggagcttaaggaaaaggagaggcgggagaagcgggagaaggatgagaaggagaaggcggagaagcagcggctcaaggaggagcggcgcaaggagagacaggaagccctggaggctaaacttgaggaaaaaaggaaaaaggaagaagagaaacggttaagagaagaagagaagcgcattaaagcagagaaggccgaaatcacgaggttcttccagaaaccaaagactccacaggcccccaagaccctggccggctcctgtgggaagtttgccccctttgaaattaaagagcacatggtcctggcccctcggcgtcggaccgctttccatccagacctctgcagtcagctggaccagctcctccagcagcagagcggcgagttctccttcttgaaagacctcaaaggccggcagcccctgaggtccggacccacgcacgtttccacccggaatgcagatatttttaacagtgatgtcgtcatcgtggagcgtgggaagggcgacggtgttcccgagaggaggaagtttggcaggatgaagctcctgcagttctgtgagaaccaccggcctgcctactggggtacctggaataagaagacggcactcatccgcgcgcgagacccctgggcccaggacacgaagctcctggactatgaggtggacagtgatgaggagtgggaagaagaggagcctggggagtccctgtcccacagtgagggggatgatgatgacgacatgggagaggatgaagatgaggacgatggtttctttgtgccccatgggtacctgtctgaggacgaaggtgtgacagaggagtgtgccgaccctgagaaccataaggtccgccagaaactgaaggccaaggagtgggacgagttcctggctaaggggaagcgctttcgcgtcctgcaacctgtgaagatcggctgcgtgtgggcggctgacagagactgcgcaggcgatgacctgaaggtactgcagcagttcgcagcctgcttcctggagaccctgccggcccaggaggagcagacgcccaaggcctccaagcgggagaggagagacgagcagatcctggcccagctgctgccgctcctgcacggcaatgtgaacgggagcaaggtcatcatccgggagttccaggagcactgccgccggggactgctcagcaaccacaccggcagcccgcggagcccctccaccacctacctgcacacccccacccccagcgaggatgccgccatcccctctaagtcccggctcaagcggctcatttccgagaactcagtgtatgagaagcggcctgacttcaggatgtgctggtacgtgcacccgcaggtgctacagagcttccagcaggagcacctgcccgtgccgtgccagtggagctatgtgacatcggtgccctcggcccccaaagaggacagtggcagcgtcccctccacggggcccagccagggcactcccatctcgctgaagaggaagtcagcgggcagcatgtgcatcacccaattcatgaagaagcgcaggcacgacggccagattggtgctgaagacatggacggcttccaggcagacacggaggaggaggaagaggaggagggcgactgtatgatcgtggatgtcccggatgctgcggaggtccaagccccgtgtggagccgcttccggagctgggggtggtgtgggggtggacaccggcaaggccaccctgacctcgagcccactgggtgcatcctga

SEQ ID NO: 7370 - DNA, 902 bp, synthetic construct
  misc_feature 1..902: note = Synthetic polypeptide
  source 1..902: mol_type = other DNA
tctgtctaccctcagccactcagaatctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttactgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctga

SEQ ID NO: 7371 - DNA, 427 bp, synthetic construct; identical to SEQ ID NO: 573
  misc_feature 1..427: note = Synthetic polypeptide
  source 1..427: mol_type = other DNA

SEQ ID NO: 7372 - DNA, 445 bp, synthetic construct; identical to SEQ ID NO: 744
  misc_feature 1..445: note = Synthetic polypeptide
  source 1..445: mol_type = other DNA

SEQ ID NO: 7373 - DNA, 59 bp, synthetic construct; identical to SEQ ID NO: 742
  misc_feature 1..59: note = Synthetic polypeptide
  source 1..59: mol_type = other DNA

SEQ ID NO: 7374 - DNA, 123 bp, synthetic construct; identical to SEQ ID NO: 743
  misc_feature 1..123: note = Synthetic polypeptide
  source 1..123: mol_type = other DNA

SEQ ID NO: 7375 - DNA, 1058 bp, synthetic construct
  misc_feature 1..1058: note = Synthetic polypeptide
  source 1..1058: mol_type = other DNA
ccctccccctccccctccccctctccctcaccctctccctctccccacggtctccctctgatgccaagccaaagctggactgtactgctgccatctcggctcactgcaacctccctgcctgattctcctgcctcagcctgcccagtgcctgtgattgcaggcgcgcgccgccacgcctgactggttttggtggagacggggtttcgctgtgttggccgggccggtctccagcccctaaccacgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcatctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccatctgagaagtgaggagcctctccgcccggcagccaccccatctgggaaggtctctcactttgtcacccaggctggagcacagcggcacaacctcgggtcactgcagccttgacttccctggctcaaacaatcctcccacctcagcctcccaagttgctggaactacaggtgcatgccacccacacccggctaattttcgtattttttgaagagacgggatctcgccatgttgcctag

SEQ ID NO: 7376 - DNA, 463 bp, synthetic construct; identical to SEQ ID NO: 524
  misc_feature 1..463: note = Synthetic polypeptide
  source 1..463: mol_type = other DNA

SEQ ID NO: 7377 - DNA, 711 bp, synthetic construct
  misc_feature 1..711: note = Synthetic polypeptide
  source 1..711: mol_type = other DNA
atagacatgaaaatgttcaacttcataagcaatgaaagaaatggaaatcaaaacagaagccatttttcaaatacatcaaattgaataggatgaaaataacactaatattctaggcagtaccaagaagcaagagagacctatcttgatctggatagtaaagtgaggactttaaaaaagtttattaaattactgggagaaatcatggagcacagattcaagacatatcaacaatttagaaggtgtttgactttacgatgcaaattatactttgacaacttactatctcagcgggcctattgtggaaaaatgaattttgaccacaagaatgaaactctaagtatatcagttcagcctggagaaggaaataaagctgctttcaatgacatgagagccttgtctggaggtgaacgttctttctccacagtgtgttttattctttccctgtggtccatcgcagaatctcctttcagatgcctggatgaatttgatgtctacatggatatggttaataggagaattgccatggacttgatactgaagatggcagattcccagcgttttagacagtttatcttgctcacacctcaaagcatgagttcacttccatccagtaaactgataagaattctccgaatgtctgatcctgaaagaggacaaactacattgcctttcagacctgtgactcaagaagaagatgatgaccaaaggtga

SEQ ID NO: 7378 - DNA, 1759 bp, synthetic construct; identical to SEQ ID NO: 6644
  misc_feature 1..1759: note = Synthetic polypeptide
  source 1..1759: mol_type = other DNA

SEQ ID NO: 7379 - DNA, 1443 bp, synthetic construct; identical to SEQ ID NO: 6760
  misc_feature 1..1443: note = Synthetic polypeptide
  source 1..1443: mol_type = other DNA

SEQ ID NO: 7380 - DNA, 984 bp, synthetic construct; identical to SEQ ID NO: 6761
  misc_feature 1..984: note = Synthetic polypeptide
  source 1..984: mol_type = other DNA

SEQ ID NO: 7381 - DNA, 1032 bp, synthetic construct; identical to SEQ ID NO: 6762
  misc_feature 1..1032: note = Synthetic polypeptide
  source 1..1032: mol_type = other DNA

SEQ ID NO: 7382 - DNA, 225 bp, synthetic construct; identical to SEQ ID NO: 7100
  misc_feature 1..225: note = Synthetic polypeptide
  source 1..225: mol_type = other DNA

SEQ ID NO: 7383 - DNA, 1392 bp, synthetic construct; identical to SEQ ID NO: 6782
  misc_feature 1..1392: note = Synthetic polypeptide
  source 1..1392: mol_type = other DNA

SEQ ID NO: 7384 - DNA, 933 bp, synthetic construct; identical to SEQ ID NO: 6783
  misc_feature 1..933: note = Synthetic polypeptide
  source 1..933: mol_type = other DNA

SEQ ID NO: 7385 - DNA, 981 bp, synthetic construct; identical to SEQ ID NO: 6784
  misc_feature 1..981: note = Synthetic polypeptide
  source 1..981: mol_type = other DNA

SEQ ID NO: 7386 - DNA, 2297 bp, synthetic construct
  misc_feature 1..2297: note = Synthetic polypeptide
  source 1..2297: mol_type = other DNA
tctccctctccctctcccgtctccccacggtctccctctccctctgtttccacggtctccctctcatgccgagccgaagctggactgtactgctgccatctcggctcactgcaacctccctgcctgattctcctgcctcagcctgccgagtgcctgcgattgcaggcacccgctgccacgcctgactggttttcgtattttttttggtggagacggggtttcgctgtgttggcctggccggtctccagctcctaaccgcgagcgatccgccagcctcggcctcccgaggtgccgggattgcagacggagtctcgttcactcagtgctcagtggtgccccggctggagtgcagtggcatgatctcggctcgctacaacctccaactcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctgggaagtgaggagcgtctccgtccggccgccatcccacctaggaagtgaggagcgcctcttcccggccgccatcccatctaggaagtgaagagcgtctctgcccggccgcccatcgtctgagatgtggggagcgcctctgccccgccgccccgtctgggatgtgaggagcgcctctgccaggccgtgaccccgtctgggaggtgaggagtgtctctgcccggccaccccgtctgagaagtgaggagaccctctgcctggcaaccgccccgtctgagaagtgaggagcccctctgcccagcagccgccccgtctgagaagtgaggagcctctccgcccggcagccaccccgtctgggaagtgaggagcgtctccgcccggcagccaccccgtccgggagggaggtgggggggtcagccccccgcccggccagccgccccgtccgggagaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagcatgggctgatgcctttcgaagcagtcctgatctcaccggcgttgtgcacatatatgaggagctgaagaggaaaggggttgaatttcccatggcagacttggacgctctgtctcccatacacacaccacagcggagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtga

SEQ ID NO: 7387 - DNA, 2447 bp, synthetic construct
  misc_feature 1..2447: note = Synthetic polypeptide
  source 1..2447: mol_type = other DNA
tctccctctccctctcccgtctccccacggtctccctctccctctgtttccacggtctccctctcatgccgagccgaagctggactgtactgctgccatctcggctcactgcaacctccctgcctgattctcctgcctcagcctgccgagtgcctgcgattgcaggcacccgctgccacgcctgactggttttcgtattttttttggtggagacggggtttcgctgtgttggcctggccggtctccagctcctaaccgcgagcgatccgccagcctcggcctcccgaggtgccgggattgcagacggagtctcgttcactcagtgctcagtggtgccccggctggagtgcagtggcatgatctcggctcgctacaacctccaactcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctgggaagtgaggagcgtctccgtccggccgccatcccacctaggaagtgaggagcgcctcttcccggccgccatcccatctaggaagtgaagagcgtctctgcccggccgcccatcgtctgagatgtggggagcgcctctgccccgccgccccgtctgggatgtgaggagcgcctctgccaggccgtgaccccgtctgggaggtgaggagtgtctctgcccggccaccccgtctgagaagtgaggagaccctctgcctggcaaccgccccgtctgagaagtgaggagcccctctgcccagcagccgccccgtctgagaagtgaggagcctctccgcccggcagccaccccgtctgggaagtgaggagcgtctccgcccggcagccaccccgtccgggagggaggtgggggggtcagccccccgcccggccagccgccccgtccgggagaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccaggcatgggctgatgcctttcgaagcagtcctgatctcaccggcgttgtgcacatatatgaggagctgaagaggaaaggggttgaatttcccatggcagacttggacgctctgtctcccatacacacaccacagcggagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtga

SEQ ID NO: 7388 - DNA, 2312 bp, synthetic construct
  misc_feature 1..2312: note = Synthetic polypeptide
  source 1..2312: mol_type = other DNA
tctccctctccctctcccgtctccccacggtctccctctccctctgtttccacggtctccctctcatgccgagccgaagctggactgtactgctgccatctcggctcactgcaacctccctgcctgattctcctgcctcagcctgccgagtgcctgcgattgcaggcacccgctgccacgcctgactggttttcgtattttttttggtggagacggggtttcgctgtgttggcctggccggtctccagctcctaaccgcgagcgatccgccagcctcggcctcccgaggtgccgggattgcagacggagtctcgttcactcagtgctcagtggtgccccggctggagtgcagtggcatgatctcggctcgctacaacctccaactcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctgggaagtgaggagcgtctccgtccggccgccatcccacctaggaagtgaggagcgcctcttcccggccgccatcccatctaggaagtgaagagcgtctctgcccggccgcccatcgtctgagatgtggggagcgcctctgccccgccgccccgtctgggatgtgaggagcgcctctgccaggccgtgaccccgtctgggaggtgaggagtgtctctgcccggccaccccgtctgagaagtgaggagaccctctgcctggcaaccgccccgtctgagaagtgaggagcccctctgcccagcagccgccccgtctgagaagtgaggagcctctccgcccggcagccaccccgtctgggaagtgaggagcgtctccgcccggcagccaccccgtccgggagggaggtgggggggtcagccccccgcccggccagccgccccgtccgggagaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccagagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtga

SEQ ID NO: 7389 - DNA, 2375 bp, synthetic construct
  misc_feature 1..2375: note = Synthetic polypeptide
  source 1..2375: mol_type = other DNA
tctccctctccctctcccgtctccccacggtctccctctccctctgtttccacggtctccctctcatgccgagccgaagctggactgtactgctgccatctcggctcactgcaacctccctgcctgattctcctgcctcagcctgccgagtgcctgcgattgcaggcacccgctgccacgcctgactggttttcgtattttttttggtggagacggggtttcgctgtgttggcctggccggtctccagctcctaaccgcgagcgatccgccagcctcggcctcccgaggtgccgggattgcagacggagtctcgttcactcagtgctcagtggtgccccggctggagtgcagtggcatgatctcggctcgctacaacctccaactcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctgggaagtgaggagcgtctccgtccggccgccatcccacctaggaagtgaggagcgcctcttcccggccgccatcccatctaggaagtgaagagcgtctctgcccggccgcccatcgtctgagatgtggggagcgcctctgccccgccgccccgtctgggatgtgaggagcgcctctgccaggccgtgaccccgtctgggaggtgaggagtgtctctgcccggccaccccgtctgagaagtgaggagaccctctgcctggcaaccgccccgtctgagaagtgaggagcccctctgcccagcagccgccccgtctgagaagtgaggagcctctccgcccggcagccaccccgtctgggaagtgaggagcgtctccgcccggcagccaccccgtccgggagggaggtgggggggtcagccccccgcccggccagccgccccgtccgggagaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccaggcatgggctgatgcctttcgaagcagtcctgatctcaccggcgttgtgcacatatatgaggagctgaagaggaaaggggttgaatttcccatggcagacttggacgctctgtctcccatacacacaccacagcggattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggacttttctgtcctcggcccagaagagaggtagaggtggggagtctgacctggagcccatagacagctggcttataacccaaggaatgatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtga

SEQ ID NO: 7390 - DNA, 2093 bp, synthetic construct
  misc_feature 1..2093: note = Synthetic polypeptide
  source 1..2093: mol_type = other DNA
tctccctctccctctcccgtctccccacggtctccctctccctctgtttccacggtctccctctcatgccgagccgaagctggactgtactgctgccatctcggctcactgcaacctccctgcctgattctcctgcctcagcctgccgagtgcctgcgattgcaggcacccgctgccacgcctgactggttttcgtattttttttggtggagacggggtttcgctgtgttggcctggccggtctccagctcctaaccgcgagcgatccgccagcctcggcctcccgaggtgccgggattgcagacggagtctcgttcactcagtgctcagtggtgccccggctggagtgcagtggcatgatctcggctcgctacaacctccaactcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctgggaagtgaggagcgtctccgtccggccgccatcccacctaggaagtgaggagcgcctcttcccggccgccatcccatctaggaagtgaagagcgtctctgcccggccgcccatcgtctgagatgtggggagcgcctctgccccgccgccccgtctgggatgtgaggagcgcctctgccaggccgtgaccccgtctgggaggtgaggagtgtctctgcccggccaccccgtctgagaagtgaggagaccctctgcctggcaaccgccccgtctgagaagtgaggagcccctctgcccagcagccgccccgtctgagaagtgaggagcctctccgcccggcagccaccccgtctgggaagtgaggagcgtctccgcccggcagccaccccgtccgggagggaggtgggggggtcagccccccgcccggccagccgccccgtccgggagaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtga

SEQ ID NO: 7391 - DNA, 2090 bp, synthetic construct
  misc_feature 1..2090: note = Synthetic polypeptide
  source 1..2090: mol_type = other DNA
tctccctctccctctcccgtctccccacggtctccctctccctctgtttccacggtctccctctcatgccgagccgaagctggactgtactgctgccatctcggctcactgcaacctccctgcctgattctcctgcctcagcctgccgagtgcctgcgattgcaggcacccgctgccacgcctgactggttttcgtattttttttggtggagacggggtttcgctgtgttggcctggccggtctccagctcctaaccgcgagcgatccgccagcctcggcctcccgaggtgccgggattgcagacggagtctcgttcactcagtgctcagtggtgccccggctggagtgcagtggcatgatctcggctcgctacaacctccaactcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctgggaagtgaggagcgtctccgtccggccgccatcccacctaggaagtgaggagcgcctcttcccggccgccatcccatctaggaagtgaagagcgtctctgcccggccgcccatcgtctgagatgtggggagcgcctctgccccgccgccccgtctgggatgtgaggagcgcctctgccaggccgtgaccccgtctgggaggtgaggagtgtctctgcccggccaccccgtctgagaagtgaggagaccctctgcctggcaaccgccccgtctgagaagtgaggagcccctctgcccagcagccgccccgtctgagaagtgaggagcctctccgcccggcagccaccccgtctgggaagtgaggagcgtctccgcccggcagccaccccgtccgggagggaggtgggggggtcagccccccgcccggccagccgccccgtccgggagaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacaattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggacttttctgtcctcggcccagaagagaggtagaggtggggagtctgacctggagcccatagacagctggcttataacccaaggaatgatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtga

SEQ ID NO: 7392 - DNA, 1232 bp, synthetic construct; identical to SEQ ID NO: 6566
  misc_feature 1..1232: note = Synthetic polypeptide
  source 1..1232: mol_type = other DNA

SEQ ID NO: 7393 - DNA, 497 bp, synthetic construct; identical to SEQ ID NO: 6567
  misc_feature 1..497: note = Synthetic polypeptide
  source 1..497: mol_type = other DNA

SEQ ID NO: 7394 - DNA, 575 bp, synthetic construct; identical to SEQ ID NO: 6568
  misc_feature 1..575: note = Synthetic polypeptide
  source 1..575: mol_type = other DNA

SEQ ID NO: 7395 - DNA, 1901 bp, synthetic construct; identical to SEQ ID NO: 7113
  misc_feature 1..1901: note = Synthetic polypeptide
  source 1..1901: mol_type = other DNA

SEQ ID NO: 7396 - DNA, 1739 bp, synthetic construct; identical to SEQ ID NO: 7114
  misc_feature 1..1739: note = Synthetic polypeptide
  source 1..1739: mol_type = other DNA

SEQ ID NO: 7397 - DNA, 1859 bp, synthetic construct; identical to SEQ ID NO: 7115
  misc_feature 1..1859: note = Synthetic polypeptide
  source 1..1859: mol_type = other DNA

SEQ ID NO: 7398 - DNA, 1616 bp, synthetic construct; identical to SEQ ID NO: 7116
  misc_feature 1..1616: note = Synthetic polypeptide
  source 1..1616: mol_type = other DNA

SEQ ID NO: 7399 - DNA, 501 bp, synthetic construct; identical to SEQ ID NO: 7117
  misc_feature 1..501: note = Synthetic polypeptide
  source 1..501: mol_type = other DNA

SEQ ID NO: 7400 - DNA, 369 bp, synthetic construct; identical to SEQ ID NO: 7118
  misc_feature 1..369: note = Synthetic polypeptide
  source 1..369: mol_type = other DNA

SEQ ID NO: 7401 - DNA, 807 bp, synthetic construct
  misc_feature 1..807: note = Synthetic polypeptide
  source 1..807: mol_type = other DNA
ggctggatgcagtggctcacgcctgtaatcccaacactttgggaggctgagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaagcttggaactggcttcagtgatgaggagctggaggagcatcaccagagcctcaaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaa

SEQ ID NO: 7402 - DNA, 453 bp, synthetic construct
  misc_feature 1..453: note = Synthetic polypeptide
  source 1..453: mol_type = other DNA
ggctggatgcagtggctcacgcctgtaatcccaacactttgggaggctgagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaaggtcctggggaactggggctga

SEQ ID NO: 7403 - DNA, 238 bp, synthetic construct; identical to SEQ ID NO: 6628
  misc_feature 1..238: note = Synthetic polypeptide
  source 1..238: mol_type = other DNA

SEQ ID NO: 7404 - DNA, 164 bp, synthetic construct; identical to SEQ ID NO: 831
  misc_feature 1..164: note = Synthetic polypeptide
  source 1..164: mol_type = other DNA

SEQ ID NO: 7405 - DNA, 193 bp, synthetic construct; identical to SEQ ID NO: 834
  misc_feature 1..193: note = Synthetic polypeptide
  source 1..193: mol_type = other DNA

SEQ ID NO: 7406 - DNA, 1031 bp, synthetic construct
  misc_feature 1..1031: note = Synthetic polypeptide
  source 1..1031: mol_type = other DNA
tgtctccccagatcatcttctcccattcttctcccactcctaccagatttatgccctccctgctccactggaactgccctggccaacctcaccagtgacctccatgtcgcccaatccaaggtcggtttttgaccttcatctggacctaacagtcgatcacctcctgctcctggaaatgcgcatgcaattcagctttcagaacaccactctcacattagctcccttcccatccaggtcctttgttggtttctcatctgctcaacctctggatgttgttcacaccagtgctctcctctaccagctaaactcacccgagtgatcttgtccggtctcatggctttaaatgccacctataggccatcatttcccaggtttatacctccagcctggactcttccctgaatccagactcataaattcatctaacttctcttggatgtctaatgcacttgtcaagatcagcacgagtccaataactctgttcttccctgcagacctgaccttctacccacatccgtgacagctcctttcttctagctgcccaggccccagcccaggccatcgagtcagtggaaaggaaaaagcaagagaaaaagcaagaacaagaggacaacttggccgagatcaccaacctcctgcgtggggacctgctctccgagaacccgcagcaggcagccagctccttcgggccccaccgcgtggtccctgaccgctggaagggcatgacccaggagcagctggagcagatccgcctagtccagaagcagcaaatccaggagaagctgaggctccaggaagaaaagcgccagcgagacctggactgggaccggcggaggattcagggggctcgcgccaccctgctgtttgagcggcagcagtggcggcggcagcgcgacctgcgcagagctctggacagcagcaacctcagcctggccaaggagcagcatttgcagaaaaaatatatgaatgaagtctatacaaatcaacccacgggagactatttcacacaatttaatacaggaagtcgataa

SEQ ID NO: 7407 - DNA, 1052 bp, synthetic construct; identical to SEQ ID NO: 447
  misc_feature 1..1052: note = Synthetic polypeptide
  source 1..1052: mol_type = other DNA

SEQ ID NO: 7408 - DNA, 1118 bp, synthetic construct; identical to SEQ ID NO: 448
  misc_feature 1..1118: note = Synthetic polypeptide
  source 1..1118: mol_type = other DNA

SEQ ID NO: 7409 - DNA, 5464 bp, synthetic construct
  misc_feature 1..5464: note = Synthetic polypeptide
  source 1..5464: mol_type = other DNA
gacctcgggttctacctacagcgtcctgtccaccatgccctcagactcagaaagcagcagctccctcagcagtgtgggcactaccgggaaggcgccgtccccaccacccctcctcactgaccagcaagtgaatgagaaggtggagaacctctccattcagctgcggctgatgacccgggagagaaacgagctccgcaagcgcctggcctttgctacgcatggcacggcctttgacaagaggccctaccacaggctgaatcctgactatgagaggctgaagatccagtgcgtgcgagccatgtcggacctgcagagcctgcagaaccagcacaccaacgccttgaagaggtgtgaggaggtggccaaggagactgacttctaccacacactccacagccggctcctgagtgaccagactcggctgaaggatgacgtggacatgctgaggcgggagaatgggcagctgctgcgggagcgaaacctgctgcagcagtcatgggaggacatgaagcggctccacgaggaggaccagaaggagatcggtgacctccgtgcccagcagcagcaggtgttgaagcacaacgggtcatccgagattctcaacaaactgtatgacacggccatggacaagttggaggtggtcaagaaggactatgacgcccttcggaagaggtacagtgagaaagtcgccatccacaatgcagacctgagccgcctggagcagctgggggaggagaaccagcggttgctgaagcagacagagatgctgacccagcagagggacacggccatccagctgcagcaccagtgcgccctctccctgaggaggtttgaggcgatccaccatgagctgaacaaggccacggcgcagaacaaggacctgcagtgggagatggagctgctgcagtcagagctgaccgagctgagaaccacgcaggtgaagacagcaaaggagtcggagaaatacagggaggagcgggacgctgtgtacagcgagtacaagctcatcatgagtgagcgtgaccaggtcatctctgagctggacaagctgcagaccgaagtggagctggccgagtccaagctcaagagcagcacatctgagaagaaggcggccaatgaggagatggaggcgctgcggcagatcaaagacacggtgacaatggatgctgggagagccaacaaggaggttgaaatccttcgaaagcagtgcaaggctctgtgccaggagctgaaggaagccctccaggaggcggatgtggccaagtgccggcgggactgggccttccaggagcgagacaagattgtagcagagcgtgacagcatccggacactgtgtgacaacctgaggcgggagcgggaccgtgcggtgagcgagctggctgaggccctgcgcagcctggatgacacccgcaagcagaagaatgatgtcagccgcgagctgaaggagctcaaggaacagatggaatcccagttggaaaaggaggcccggttccgacagctgatggcccacagctcccacgactcggccattgacacggattccatggagtgggaaacggaagttgtagagttcgagagggagacggaggatattgacttgaaggcactggggtttgatatggcagaaggtgtgaatgagccttgtttcccgggggactgtggcatatttgtcactaaagtggacaaaggaagcattgctgatggccgcttaagggtcaatgactggctgctgagaatcaacgatgtggacctcatcaacaaggacaagaagcaggccatcaaggcgctcctcaatggggagggggccatcaacatggtcgtgcggcggaggaagtccctgggtgggaaggtggtcacgccgctgcacatcaacctcagtggacagaaagacagtggcatcagtctggagaatggagtgtatgctgccgctgtgctgcctggaagccctgccgctaaagaagggtcccttgctgtgggagacaggatcgttgcgatcaatggcattgcactggacaacaagtctctgaatgaatgtgaatctctgctgcgcagctgccaggactccctgaccctgtccctcctgaaggtattccctcagagctcctcgtggagtggccagaacatttttgaaaatatcaaagactctgataagatgctgagttttcgagcccatggcccggaggtccaggctcataacaaacggaacttgatacagcacaataactccacgcagacagacatcttctacacggacaggctggaagacaggaaggagccaggccccccaggaggcagcagctcctttctgcataagccattccctgggggacccttgcaggtctgcccccaggcctgtcccagtgcctctgagcgtagcctgagctccttccgctcagatgcctctggggaccgtggctttgggctggtggacgtgcgtggccggcggccactgctgccctttgagaccgaggtgggcccctgtggggttggggaggcctccctggacaaggcagactctgaaggctccaacagcggcgggacctggcccaaggccatgctcagctccacggcagtgcctgagaagctctctgtttataaaaagccaaagcaaagaaagtccatctttgaccctaacactttcaaacgcccccagacaccccccaaaatagactacctgcttccaggtcctgggcctgctcactctccccagccctccaagagggcggggcctctgacacccccaaaacctcccagaaggagcgactccattaagttccagcacaggctggagactagctccgagtcagaagccactctggtgggcagctccccatccactagtcccccgagcgccctgccccctgacgtggaccccggggagcccatgcacgcatcaccccctcgcaaggccagggtccgcattgcttccagctactaccctgaaggagatggggactcctcccacctgccggccaagaaatcctgtgatgaggacctcacctcccagaaggtggatgagctggggcagaagcgtcgccggccaaaatctgctcccagttttcggccgaagcttgctccagtagtgattcctgctcagttcctggaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggggtcatccagggaggagccctgtcaagcatttgcactcagatcttggcaatggtcaatcaagaacaaaataaagtcctgtggattccagcctgcccgctctag

SEQ ID NO: 7410 - DNA, 4444 bp, synthetic construct
  misc_feature 1..4444: note = Synthetic polypeptide
  source 1..4444: mol_type = other DNA
gacctcgggttctacctacagcgtcctgtccaccatgccctcagactcagaaagcagcagctccctcagcagtgtgggcactaccgggaaggcgccgtccccaccacccctcctcactgaccagcaagtgaatgagaaggtggagaacctctccattcagctgcggctgatgacccgggagagaaacgagctccgcaagcgcctggcctttgctacgcatggcacggcctttgacaagaggccctaccacaggctgaatcctgactatgagaggctgaagatccagtgcgtgcgagccatgtcggacctgcagagcctgcagaaccagcacaccaacgccttgaagaggtgtgaggaggtggccaaggagactgacttctaccacacactccacagccggctcctgagtgaccagactcggctgaaggatgacgtggacatgctgaggcgggagaatgggcagctgctgcgggagcgaaacctgctgcagcagtcatgggaggacatgaagcggctccacgaggaggaccagaaggagatcggtgacctccgtgcccagcagcagcaggtgttgaagcacaacgggtcatccgagattctcaacaaactgtatgacacggccatggacaagttggaggtggtcaagaaggactatgacgcccttcggaagaggtacagtgagaaagtcgccatccacaatgcagacctgagccgcctggagcagctgggggaggagaaccagcggttgctgaagcagacagagatgctgacccagcagagggacacggccatccagctgcagcaccagtgcgccctctccctgaggaggtttgaggcgatccaccatgagctgaacaaggccacggcgcagaacaaggacctgcagtgggagatggagctgctgcagtcagagctgaccgagctgagaaccacgcaggtgaagacagcaaaggagtcggagaaatacagggaggagcgggacgctgtgtacagcgagtacaagctcatcatgagtgagcgtgaccaggtcatctctgagctggacaagctgcagaccgaagtggagctggccgagtccaagctcaagagcagcacatctgagaagaaggcggccaatgaggagatggaggcgctgcggcagatcaaagacacggtgacaatggatgctgggagagccaacaaggaggttgaaatccttcgaaagcagtgcaaggctctgtgccaggagctgaaggaagccctccaggaggcggatgtggccaagtgccggcgggactgggccttccaggagcgagacaagattgtagcagagcgtgacagcatccggacactgtgtgacaacctgaggcgggagcgggaccgtgcggtgagcgagctggctgaggccctgcgcagcctggatgacacccgcaagcagaagaatgatgtcagccgcgagctgaaggagctcaaggaacagatggaatcccagttggaaaaggaggcccggttccgacagctgatggcccacagctcccacgactcggccattgacacggattccatggagtgggaaacggaagttgtagagttcgagagggagacggaggatattgacttgaaggcactggggtttgatatggcagaaggtgtgaatgagccttgtttcccgggggactgtggcatatttgtcactaaagtggacaaaggaagcattgctgatggccgcttaagggtcaatgactggctgctgagaatcaacgatgtggacctcatcaacaaggacaagaagcaggccatcaaggcgctcctcaatggggagggggccatcaacatggtcgtgcggcggaggaagtccctgggtgggaaggtggtcacgccgctgcacatcaacctcagtggacagaaagacagtggcatcagtctggagaatggagtgtatgctgccgctgtgctgcctggaagccctgccgctaaagaagggtcccttgctgtgggagacaggatcgttgcgatcaatggcattgcactggacaacaagtctctgaatgaatgtgaatctctgctgcgcagctgccaggactccctgaccctgtccctcctgaaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggggtcatccagggaggagccctgtcaagcatttgcactcagatcttggcaatggtcaatcaagaacaaaataaagtcctgtggattccagcctgcccgctctag

SEQ ID NO: 7411 - DNA, 574 bp, synthetic construct
  misc_feature 1..574: note = Synthetic polypeptide
  source 1..574: mol_type = other DNA
gacctcgggttctacctacagcgtcctgtccaccatgccctcagactcagaaagcagcagctccctcagcagtgtgggcactaccgggaaggcgccgtccccaccacccctcctcactgaccagcaagtgaatgagaaggtggagaacctctccattcagctgcggctgatgacccgggagagaaacgagctccgcaagcgcctggcctttgctacgcatggcacggcctttgacaagaggccctaccacaggctgaatcctgactatgagaggctgaagatccagtgcgtgcgagccatgtcggacctgcagagcctgcagaaccagcacaccaacgccttgaagaggtgtgaggaggtggccaaggagactgacttctaccacacactccacagccggctcctgagtgaccagactcggctgaaggatgacgtggacatgctgaggcgggagaatgggcagctgctgcgggagcgaaacctgctgcagcagtcatgggaggacatgaagcggctccacgaggaggaccagaaggagatcggtgacctccgtgcccagcagcagcagagctga

SEQ ID NO: 7412 - DNA, 677 bp, synthetic construct; identical to SEQ ID NO: 747
  misc_feature 1..677: note = Synthetic polypeptide
  source 1..677: mol_type = other DNA

SEQ ID NO: 7413 - DNA, 674 bp, synthetic construct; identical to SEQ ID NO: 748
  misc_feature 1..674: note = Synthetic polypeptide
  source 1..674: mol_type = other DNA

SEQ ID NO: 7414 - DNA, 1490 bp, synthetic construct
  misc_feature 1..1490: note = Synthetic polypeptide
  source 1..1490: mol_type = other DNA
ggcctgggaggggcccggccggcggggctgagcctgtgcgtcctggggtgaggcctgggaggggcccggccggcggggctgagcctgtgcgtcctggggtgaggcctgggaggggcccggcggggctgagcctgtgcgtcctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtga

SEQ ID NO: 7415 - DNA, 1031 bp, synthetic construct
  misc_feature 1..1031: note = Synthetic polypeptide
  source 1..1031: mol_type = other DNA
ggcctgggaggggcccggccggcggggctgagcctgtgcgtcctggggtgaggcctgggaggggcccggccggcggggctgagcctgtgcgtcctggggtgaggcctgggaggggcccggcggggctgagcctgtgcgtcctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggccgctga

SEQ ID NO: 7416 - DNA, 1079 bp, synthetic construct
  misc_feature 1..1079: note = Synthetic polypeptide
  source 1..1079: mol_type = other DNA
ggcctgggaggggcccggccggcggggctgagcctgtgcgtcctggggtgaggcctgggaggggcccggccggcggggctgagcctgtgcgtcctggggtgaggcctgggaggggcccggcggggctgagcctgtgcgtcctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgagtgcgcgcgcaggatgaagaagtgcatcaggtgccaggtggtcgtcagcaagaaactgcgcccagacggctctga

SEQ ID NO: 7417 - DNA, 829 bp, synthetic construct; identical to SEQ ID NO: 624
  misc_feature 1..829: note = Synthetic polypeptide
  source 1..829: mol_type = other DNA

SEQ ID NO: 7418 - DNA, 2120 bp, synthetic construct; identical to SEQ ID NO: 6752
  misc_feature 1..2120: note = Synthetic polypeptide
  source 1..2120: mol_type = other DNA

SEQ ID NO: 7419 - DNA, 1257 bp, synthetic construct; identical to SEQ ID NO: 625
  misc_feature 1..1257: note = Synthetic polypeptide
  source 1..1257: mol_type = other DNA

SEQ ID NO: 7420 - DNA, 1215 bp, synthetic construct; identical to SEQ ID NO: 626
  misc_feature 1..1215: note = Synthetic polypeptide
  source 1..1215: mol_type = other DNA

SEQ ID NO: 7421 - DNA, 507 bp, synthetic construct; identical to SEQ ID NO: 628
  misc_feature 1..507: note = Synthetic polypeptide
  source 1..507: mol_type = other DNA

SEQ ID NO: 7422 - DNA, 313 bp, synthetic construct; identical to SEQ ID NO: 629
  misc_feature 1..313: note = Synthetic polypeptide
  source 1..313: mol_type = other DNA

SEQ ID NO: 7423 - DNA, 291 bp, synthetic construct; identical to SEQ ID NO: 630
  misc_feature 1..291: note = Synthetic polypeptide
  source 1..291: mol_type = other DNA

SEQ ID NO: 7424 - DNA, 842 bp, synthetic construct; identical to SEQ ID NO: 6534
  misc_feature 1..842: note = Synthetic polypeptide
  source 1..842: mol_type = other DNA

SEQ ID NO: 7425 - DNA, 943 bp, synthetic construct; identical to SEQ ID NO: 6540
  misc_feature 1..943: note = Synthetic polypeptide
  source 1..943: mol_type = other DNA

SEQ ID NO: 7426 - DNA, 2725 bp, synthetic construct; identical to SEQ ID NO: 6753
  misc_feature 1..2725: note = Synthetic polypeptide
  source 1..2725: mol_type = other DNA

SEQ ID NO: 7427 - DNA, 2825 bp, synthetic construct; identical to SEQ ID NO: 6727
  misc_feature 1..2825: note = Synthetic polypeptide
  source 1..2825: mol_type = other DNA

SEQ ID NO: 7428 - DNA, 1967 bp, synthetic construct
  misc_feature 1..1967: note = Synthetic polypeptide
  source 1..1967: mol_type = other DNA
acggtctccctctcatgcggagccgaagctggactgtactgctgccatctcggctcactgcaacctccctgcctgattctcctgcctcagtctgccgaatgcctgtgattgcaggcacgcgccgccacgcctgactggttttggtggagacggggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctctgcccggccgccatcccatctaggaagtgaggagcgcctcttcccagccgccatcacatctaggaagtgaagagcctctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaaagatggatttataaaagctattggtcctgctgatgttattcaaagacagttttctggagaaacttttgaagaaataattgactgctctgggaaatgtattctaccaggtttggtggatgcacacacacatccagtatgggctggtgaaagagttcacgaatttgcaatgaagttggcaggagccacctacatggaaattcaccaggccggaggagggatccactttaccgtggagcgcacgcgccaagccacagaggaggagctgttccgctccttgcagcaacggctccagtgcatgatgagggctggcaccacgctggtggagtgcaagagtggatatggcctcgacctggagaccgagctcaagatgctgcgcgtgattgagcgcgcccggcgggagctggacatcggcatctcggctacctactgcggggctcattcagtgcctaaaggaaaaactgctactgaagctgctgatgacatcatcaataaccacctcccaaagctgaaggaacttggcagaaatggggaaatacacgtggacaatatagacgtattttgtgagaaaggtgtctttgatctcgattccaccagaaggattcttcaacgtggaaaagatatagggttacagattaacttccatggggatgaactccacccgatgaaggctgctgagcttggggctgaactgggagcgcaggcaatcagccacctggaagaagtgagtgatgaaggcatcgttgccatggcaacggccaggtgctctgccatccttctgcccaccacagcctacatgctgagactgaaacaacctcgagccaggaagatgttagatgaaggagtaatagttgctctgggaagtgatttcaaccccaatgcatattgcttttcaatgccaatggtcatgcatctggcctgtgtaaacatgagaatgtccatgcctgaggccttggccgctgccaccatcaatgcagcttatgcactgggaaagtctcacacacacggatcgttggaagttggcaaacagggagatctcattatcatcaattcatcccgatgggagcatttgatttaccagttcggaggccatcatgaattaattgaatatgttatagctaaaggaaaactcatctataaaacatga

SEQ ID NO: 7429 - DNA, 1142 bp, synthetic construct
  misc_feature 1..1142: note = Synthetic polypeptide
  source 1..1142: mol_type = other DNA
acggtctccctctcatgcggagccgaagctggactgtactgctgccatctcggctcactgcaacctccctgcctgattctcctgcctcagtctgccgaatgcctgtgattgcaggcacgcgccgccacgcctgactggttttggtggagacggggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctctgcccggccgccatcccatctaggaagtgaggagcgcctcttcccagccgccatcacatctaggaagtgaagagcctctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaaagatggatttataaaagctattggtcctgctgatgttattcaaagacagttttctggagaaacttttgaagaaataattgactgctctgggaaatgtattctaccagttggcaggagccacctacatggaaattcaccaggccggaggagggatccactttaccgtggagcgcacgcgccaagccacagaggaggagctgttccgctccttgcagcaacggctccagtgcatgatgagggctggcaccacgctggtggagtgcaagagtggatatggcctcgacctggagaccgagctcaagatgctgcgcgtgattga

SEQ ID NO: 7430 - DNA, 3055 bp, synthetic construct; identical to SEQ ID NO: 709
  misc_feature 1..3055: note = Synthetic polypeptide
  source 1..3055: mol_type = other DNA

SEQ ID NO: 7431 - DNA, 3058 bp, synthetic construct; identical to SEQ ID NO: 710
  misc_feature 1..3058: note = Synthetic polypeptide
  source 1..3058: mol_type = other DNA

SEQ ID NO: 7432 - DNA, 670 bp, synthetic construct
  misc_feature 1..670: note = Synthetic polypeptide
  source 1..670: mol_type = other DNA
gccagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatag

SEQ ID NO: 7433 - DNA, 718 bp, synthetic construct
  misc_feature 1..718: note = Synthetic polypeptide
  source 1..718: mol_type = other DNA
gccagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggcaatgcggaatatcaatcccagcacagcaaattctccaaaatgtcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatag

SEQ ID NO: 7434 - DNA, 682 bp, synthetic construct
  misc_feature 1..682: note = Synthetic polypeptide
  source 1..682: mol_type = other DNA
gccagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggccacaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatag

SEQ ID NO: 7435 - DNA, 730 bp, synthetic construct
  misc_feature 1..730: note = Synthetic polypeptide
  source 1..730: mol_type = other DNA
gccagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggccacaggcaatgcggaatatcaatcccagcacagcaaattctccaaaatgtcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatag

SEQ ID NO: 7436 - DNA, 1815 bp, synthetic construct; identical to SEQ ID NO: 581
  misc_feature 1..1815: note = Synthetic polypeptide
  source 1..1815: mol_type = other DNA

SEQ ID NO: 7437 - DNA, 1516 bp, synthetic construct; identical to SEQ ID NO: 534
  misc_feature 1..1516: note = Synthetic polypeptide
  source 1..1516: mol_type = other DNA

SEQ ID NO: 7438 - DNA, 591 bp, synthetic construct; identical to SEQ ID NO: 539
  misc_feature 1..591: note = Synthetic polypeptide
  source 1..591: mol_type = other DNA

SEQ ID NO: 7439 - DNA, 482 bp, synthetic construct; identical to SEQ ID NO: 540
  misc_feature 1..482: note = Synthetic polypeptide
  source 1..482: mol_type = other DNA

SEQ ID NO: 7440 - DNA, 444 bp, synthetic construct; identical to SEQ ID NO: 541
  misc_feature 1..444: note = Synthetic polypeptide
  source 1..444: mol_type = other DNA

SEQ ID NO: 7441 - DNA, 334 bp, synthetic construct; identical to SEQ ID NO: 533
  misc_feature 1..334: note = Synthetic polypeptide
  source 1..334: mol_type = other DNA

SEQ ID NO: 7442 - DNA, 38 bp, synthetic construct; identical to SEQ ID NO: 543
  misc_feature 1..38: note = Synthetic polypeptide
  source 1..38: mol_type = other DNA

SEQ ID NO: 7443 - DNA, 245 bp, synthetic construct; identical to SEQ ID NO: 542
  misc_feature 1..245: note = Synthetic polypeptide
  source 1..245: mol_type = other DNA

SEQ ID NO: 7444 - DNA, 103 bp, synthetic construct
  misc_feature 1..103: note = Synthetic polypeptide
  source 1..103: mol_type = other DNA
ggctgggcatggtggctcgcgtctgtaatcccaacactatgggaggctaagatttctctatgaatcatcatcaagaactctgggagaacttttgaattcataa

SEQ ID NO: 7445 - DNA, 509 bp, synthetic construct
  misc_feature 1..509: note = Synthetic polypeptide
  source 1..509: mol_type = other DNA
ggccgggcgcggtggctcacgcctgtaatcctagcactctgggaggccgaggcgggcggatcacgaggtcaggagatcaagaccatcctggctaacacggtgaccaaagccacgtaatgtccgtagttcgctcatccgtccatgccagatggattgtggggaaggtgattgggacaaaaatgcaaaagactgctaaagtgagagtgaccaggcttgttctggatccctatttattaaagtattttaataagcggaaaacctactttgctcacgatgcccttcagcagtgcacagttggggatattgtgcttctcagagctttacctgttccacgagcaaagcatgtgaaacatgaactggctgagatcgttttcaaagttggaaaagtcatagatccagtgacaggaaagccctgtgctggaactacctacctggagagtccgttgagttcggaaaccacccagctaagcaaaaatctggaagaactcaatatctcttcagcacagtga

SEQ ID NO: 7446 - DNA, 1222 bp, synthetic construct; identical to SEQ ID NO: 6653
  misc_feature 1..1222: note = Synthetic polypeptide
  source 1..1222: mol_type = other DNA

SEQ ID NO: 7447 - DNA, 451 bp, synthetic construct; identical to SEQ ID NO: 6654
  misc_feature 1..451: note = Synthetic polypeptide
  source 1..451: mol_type = other DNA

SEQ ID NO: 7448 - DNA, 292 bp, synthetic construct; identical to SEQ ID NO: 6655
  misc_feature 1..292: note = Synthetic polypeptide
  source 1..292: mol_type = other DNA

SEQ ID NO: 7449 - DNA, 504 bp, synthetic construct; identical to SEQ ID NO: 6656
  misc_feature 1..504: note = Synthetic polypeptide
  source 1..504: mol_type = other DNA

SEQ ID NO: 7450 - DNA, 449 bp, synthetic construct; identical to SEQ ID NO: 6657
  misc_feature 1..449: note = Synthetic polypeptide
  source 1..449: mol_type = other DNA

SEQ ID NO: 7451 - DNA, 454 bp, synthetic construct; identical to SEQ ID NO: 6658
  misc_feature 1..454: note = Synthetic polypeptide
  source 1..454: mol_type = other DNA

SEQ ID NO: 7452 - DNA, 353 bp, synthetic construct; identical to SEQ ID NO: 7197
  misc_feature 1..353: note = Synthetic polypeptide
  source 1..353: mol_type = other DNA

SEQ ID NO: 7453 - DNA, 121 bp, synthetic construct; identical to SEQ ID NO: 7198
  misc_feature 1..121: note = Synthetic polypeptide
  source 1..121: mol_type = other DNA

SEQ ID NO: 7454 - DNA, 701 bp, synthetic construct; identical to SEQ ID NO: 658
  misc_feature 1..701: note = Synthetic polypeptide
  source 1..701: mol_type = other DNA

SEQ ID NO: 7455 - DNA, 2419 bp, synthetic construct
  misc_feature 1..2419: note = Synthetic polypeptide
  source 1..2419: mol_type = other DNA
tttggtgccgtgactcggatcgggggacctcccttgggagatcaatcccccatcctcctgctctttgctccatgagaaaaatccacctatgaccttaggtcctcagaccgaccagcccaagaaacatctcaccaatttcaaatccggtaagcggcctctttttactctcttctccaacctccctcactatccctcaacctctttctcctttcaatcttggcaccacacttcaatctctcccttctcttaatttcaattcctttcattttctggtagagacaaaggagacacgttttatccgtggacccaaaactccggcgctggccacagactgggaaggcagccttcccttggtgtttaatcattgcagggacacctctctgattattcactcacgtttcaagggtgtcagaccacgcagggacgcctgccttggtccttcacccttagcggcaagtcccgcttttctggggaaggggcaagtaccccaaccccttctctccttgtctctaccccttctctgctcttctgggggaggggcaagtacccctcaaccccttctccttcatccttagtggcaagtcccgctttcctggggcaggggcaagtacccctcaaccccttctccttcacccttagcggcaagtcccgctttcctagggggcaaaaaacccccaatcgcttatttctgcaccctgacctcttatctctgtgccctaatcccttatttccgtgccccaaccccttctctgcttttctggagggcaagaacccccccaccccttctccatgtctctactcttttctctgggcttgcctccttcactatgggcaagcttccaccttccattcctccttcttctcccttagcctgtgttctcaaaaacttaaaacctcttcaactcacacctgacctaaaatctaaatgacttattttcttctgcaatgccgcttgaccccaatacaaaccgacagtagttccaaatagccagaaaatggcactttgaatttttccatcctgcaagatctaaataattcttgttgtaaaataggcaaacggtctgaggtgcctgacgtccaggcattcttttacacatcagtcccttcctagtctctgtgcccagtgcaactcgtcccaaatcttccttctttccctcccgcctgtccccccagtcccaaccccaagcgtcgctgagtctttctaatcttccttttctacagacccgtctgacctctcccctcctcgccaggccgagctaggcctcaattcttcctcagcctctgctcctccaccctataatctttttatcgcctcccctcctcacacctggtcctgcttacagtttcgttccgtgactagccctcccccacctgcccagcaatttactcttaaaaaggtggctggagctaaaggcatagtcaaggttaatgctcctttttctttatcccaaatcagatagcatttaggctctttttcatcaaatataaaaatccagcccagttcatgacgtgtttggcagcaaccctgagacactttacagccctagaccctaaaaggtcaaaaggccatcttattctcaaaatacattttattagccaatctgctcccgacattaaataaaactccaaaaattagattccggccctcaaaccccacaacaggatttaattaacctcgccttcaaggtgtacaataatagaaaaaagttgcaattccttgcctccactgtgagacaaaccccagccacatctccagcacacaagaacttccaaacgcctgaaccgcagcagccaggcgttcctccagaacctcctcccacaggagcttgctacacgtgccggaaatctggccactgggccaaggaatgcccgcagcccgggattcctcctaagccgcgtcccatctctctgggaccccactgaaaatcggactgttcaactcacctggcagccactcccagagcccctggaactctggcccaaggctctctgactgactccttcccagatcttctcggcttagcggctgaagactgacactgcccgatcgcctcggaagccccctagaccatcacagacgccgagcttccggtaactctcacagtgcaagatttaccggaacattccaggatttttacgtacacttatggatgccctgagaaaagacaaaataatctttcctaatgatgaaaatgttaaattcctttcttctcctcttctcatcttacatggagaggatgacaggacagtgcctttggagtatgggaaaaagctctatgaaattgcacgcaatgcatacaggaacaaagagagggtcaagatggttatctttcctcctggcttccaacacaacctgctttgtaaaagccccacactgttaataaccgtgagagatttcctgagcaagcagtggtcatga

SEQ ID NO: 7456 - DNA, 407 bp, synthetic construct
  misc_feature 1..407: note = Synthetic polypeptide
  source 1..407: mol_type = other DNA
ggccaggcgcagtggctcacacctgtaatcccagcactttgggacgccgaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactg

SEQ ID NO: 7457 - DNA, 481 bp, synthetic construct
  misc_feature 1..481: note = Synthetic polypeptide
  source 1..481: mol_type = other DNA
ggccaggcgcagtggctcacacctgtaatcccagcactttgggacgccgaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtga

SEQ ID NO: 7458 - DNA, 236 bp, synthetic construct
  misc_feature 1..236: note = Synthetic polypeptide
  source 1..236: mol_type = other DNA
ggccaggcgcagtggctcacacctgtaatcccagcactttgggacgccgaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtgg

SEQ ID NO: 7459 - DNA, 116 bp, synthetic construct
  misc_feature 1..116: note = Synthetic polypeptide
  source 1..116: mol_type = other DNA
ggccaggcgcagtggctcacacctgtaatcccagcactttgggacgccgaggatgcctgccatattagatggagaggaggcagtttctaaatggcttgactttggtgaagtctcaa

SEQ ID NO: 7460 - DNA, 107 bp, synthetic construct
  misc_feature 1..107: note = Synthetic polypeptide
  source 1..107: mol_type = other DNA
ggccaggcgcagtggctcacacctgtaatcccagcactttgggacgccgaggatgcctgccatattagatggagaggaggcagtttctaaatggcttgactttggtg

SEQ ID NO: 7461 - DNA, 1579 bp, synthetic construct
  misc_feature 1..1579: note = Synthetic polypeptide
  source 1..1579: mol_type = other DNA
cctctctttccatggtctccctctcatgcggagccggactggactgtactgctgccatctcggctcactgcaacctccctgcctgattctcctgcctcagcctgccgagtgcctgcgattgcaggcacgcgccgccacgcctgactggttttggtggagacggggtttcgctgtgttggccgggccggtctccagcccctaaccgcgagtgatccgccagcctcggcctcccgaggtgccaggattgcagacggagtctcgttcactcagtgctcaatggtgcccaggctggagtgcagtggcgtgatctcggctcgctacaacctacacctcccagccgcctgccttggcctcctaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgcctcttcccagccgccatcccatctaggaagtgaggagcgcctcttcccagccgccatcacatctaggaagtgaggagcgtctctgcccggccgcccatcgtctgagatgtggggagtgcctctgccccgcggccccatctgggatgtgaggagcacctctgcccggccgcgaccccgtctgggaggtgaggagcgtctctgcccggccaccccgtctgagaagtgaggagaccctctgcctggcaaccaccccgtctgagaagtgaggagcccctccgcccggcagctgccccgtctgagaattggagttcgcggtgcagatgacctgtcagagctgtgtggacgcggtgcgcaaatccctgcaaggggtggcaggtgtccaggatgtggaggtgcacttggaggaccagatggtcttggtacacaccactctacccagccaggaggtgcaggctctcctggaaggcacggggcggcaggcggtactcaagggcatgggcagcggccagttgcagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacagctgtgggaatcactttaaccctgatggagcatctcatgggggcccccaggactctgaccggcaccgcggagacctgggcaatgtccgtgctgatgctgacggccgcgccatcttcagaatggaggatgagcagctgaaggtgtgggatgtgattggccgcagcctgattattgatgagggagaagatgacctgggccggggaggccatcccttatccaagatcacagggaactccggggagaggttggcctgtggcatcattgcacgctccgctggccttttccagaaccccaagcagatctgctcttgcgatggcctcaccatctgggaggagcgaggccggcccatcgctggcaagggccgaaaggagtcagcgcagccccctgcccacctttga

SEQ ID NO: 7462 - DNA, 1504 bp, synthetic construct
  misc_feature 1..1504: note = Synthetic polypeptide
  source 1..1504: mol_type = other DNA
cctctctttccatggtctccctctcatgcggagccggactggactgtactgctgccatctcggctcactgcaacctccctgcctgattctcctgcctcagcctgccgagtgcctgcgattgcaggcacgcgccgccacgcctgactggttttggtggagacggggtttcgctgtgttggccgggccggtctccagcccctaaccgcgagtgatccgccagcctcggcctcccgaggtgccaggattgcagacggagtctcgttcactcagtgctcaatggtgcccaggctggagtgcagtggcgtgatctcggctcgctacaacctacacctcccagccgcctgccttggcctcctaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgcctcttcccagccgccatcccatctaggaagtgaggagcgcctcttcccagccgccatcacatctaggaagtgaggagcgtctctgcccggccgcccatcgtctgagatgtggggagtgcctctgccccgcggccccatctgggatgtgaggagcacctctgcccggccgcgaccccgtctgggaggtgaggagcgtctctgcccggccaccccgtctgagaagtgaggagaccctctgcctggcaaccaccccgtctgagaagtgaggagcccctccgcccggcagctgccccgtctgagaattggagttcgcggtgcagatgacctgtcagagctgtgtggacgcggtgcgcaaatccctgcaaggggtggcaggtgtccaggatgtggaggtgcacttggaggaccagatggtcttggtacacaccactctacccagccaggaggtgcaggctctcctggaaggcacggggcggcaggcggtactcaagggcatgggcagcggccagttgcagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacagctgtgggaatcactttaaccctgatggagcatctcatgggggcccccaggactctgaccggacagggccaagaggaccttgcctgcccagtccttggggagctcagatcctacgagactggtacccacaggaggaaatgggtactttagggaagcaggaagaggcgtcggaatcaggaaatcagaagatagcagcttggcaccacgtggcacacatcccctatacacacactggatctcattccagcaccgcggagacctgggcaatgtccgtgctgatgctgacggccgcgccatcttcagaatggaggatgagcagctga

SEQ ID NO: 7463 - DNA, 309 bp, synthetic construct; identical to SEQ ID NO: 6536
  misc_feature 1..309: note = Synthetic polypeptide
  source 1..309: mol_type = other DNA

SEQ ID NO: 7464 - DNA, 1016 bp, synthetic construct; identical to SEQ ID NO: 6795
  misc_feature 1..1016: note = Synthetic polypeptide
  source 1..1016: mol_type = other DNA

SEQ ID NO: 7465 - DNA, 1187 bp, synthetic construct; identical to SEQ ID NO: 6796
  misc_feature 1..1187: note = Synthetic polypeptide
  source 1..1187: mol_type = other DNA

SEQ ID NO: 7466 - DNA, 965 bp, synthetic construct; identical to SEQ ID NO: 6797
  misc_feature 1..965: note = Synthetic polypeptide
  source 1..965: mol_type = other DNA

SEQ ID NO: 7467 - DNA, 961 bp, synthetic construct; identical to SEQ ID NO: 6722
  misc_feature 1..961: note = Synthetic polypeptide
  source 1..961: mol_type = other DNA

SEQ ID NO: 7468 - DNA, 2532 bp, synthetic construct
  misc_feature 1..2532: note = Synthetic polypeptide
  source 1..2532: mol_type = other DNA
ctgtaagacctgcactttgggaggccaaggcgggtggctcacctgaggtcagtagttcaagaccagcctggccaacatggtgaaatcccatctctactaaaaatacaaaaaaatagctggatgtggtggtgggcgcctgtcatcccagctactcgggaggctgaggcaggagaatcgcatgaacccaggaggcagaggttgcagtgagccaagatcacaccattgcactccagcctgggcgaggagaccccgaaagaaagcctcacagaggctgaagtggccacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgcccccgggccaagaattcccaccagccatggtggatgctgggaagggcaagacagcagaggccagaaagacgtggctggaggagcaaggcatgatcctgaagcagacgttctgcgaggttcccgacctggaccgaattatccccgtgctgctggagcacggcctggaacgtctcccggagcactgcaagctgagcccagggattcccctgaaaccaatgttggcccatcccacccggggcatcagcgaggtcctgaaacgctttgaggaggcagctttcacctgcgaatacaaatatgacgggcagagggcacagatccacgccctggaaggcggggaggtgaagatcttcagcaggaatcaggaagacaacactgggaagtacccggacatcatcagccgcatccccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaagcttggaactggcttcagtgatgaggagctggaggagcatcaccagagcctcaaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaa

SEQ ID NO: 7469 - DNA, 2178 bp, synthetic construct
  misc_feature 1..2178: note = Synthetic polypeptide
  source 1..2178: mol_type = other DNA
ctgtaagacctgcactttgggaggccaaggcgggtggctcacctgaggtcagtagttcaagaccagcctggccaacatggtgaaatcccatctctactaaaaatacaaaaaaatagctggatgtggtggtgggcgcctgtcatcccagctactcgggaggctgaggcaggagaatcgcatgaacccaggaggcagaggttgcagtgagccaagatcacaccattgcactccagcctgggcgaggagaccccgaaagaaagcctcacagaggctgaagtggccacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgcccccgggccaagaattcccaccagccatggtggatgctgggaagggcaagacagcagaggccagaaagacgtggctggaggagcaaggcatgatcctgaagcagacgttctgcgaggttcccgacctggaccgaattatccccgtgctgctggagcacggcctggaacgtctcccggagcactgcaagctgagcccagggattcccctgaaaccaatgttggcccatcccacccggggcatcagcgaggtcctgaaacgctttgaggaggcagctttcacctgcgaatacaaatatgacgggcagagggcacagatccacgccctggaaggcggggaggtgaagatcttcagcaggaatcaggaagacaacactgggaagtacccggacatcatcagccgcatccccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaaggtcctggggaactggggctga

SEQ ID NO: 7470 - DNA, 1116 bp, synthetic construct
  misc_feature 1..1116: note = Synthetic polypeptide
  source 1..1116: mol_type = other DNA
ctgtaagacctgcactttgggaggccaaggcgggtggctcacctgaggtcagtagttcaagaccagcctggccaacatggtgaaatcccatctctactaaaaatacaaaaaaatagctggatgtggtggtgggcgcctgtcatcccagctactcgggaggctgaggcaggagaatcgcatgaacccaggaggcagaggttgcagtgagccaagatcacaccattgcactccagcctgggcgaggagaccccgaaagaaagcctcacagaggctgaagtggccacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggccgcgagagaagggagacacgcagccacaactgtcaccctcgacacccccacccgcgctctcccctgaaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatag

SEQ ID NO: 7471 - DNA, 999 bp, synthetic construct
  misc_feature 1..999: note = Synthetic polypeptide
  source 1..999: mol_type = other DNA
caccccgcttagatgatttttgatcctactatgagcaagaagaaaaagaagaagaagaagccttttatgttagatgaggaaggggatacccaaacagaggaaacccagccttcagaaacaaaagaagtggagccagagccaactgaggacaaggatttggaagctgatgaagaggacactaggaaaaaagatgcttctgatgatctagatgacttgaacttctttaatcaaaagaaaaagaagaaaaaaactaaaaagatatttgatattgatgaagctgaagaaggtgtaaaggatcttaagattgaaagtgatgttcaagaaccaactgaaccagaggatgaccttgacattatgcttggcaataaaaagaagaaaaagaagaatgttaagttcccagatgaggatgaaatactagagaaagatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcagcccaaacatctccttgcatttttgttggctgaattgggtacaagtggttctatagatggtaataaccaacttgtaatcaaaggaagattccaacagaaacagatagaaaatgtcttgagaagatatatcaaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaa

SEQ ID NO: 7472 - DNA, 112 bp, synthetic construct; identical to SEQ ID NO: 7120
  misc_feature 1..112: note = Synthetic polypeptide
  source 1..112: mol_type = other DNA

SEQ ID NO: 7473 - DNA, 659 bp, synthetic construct
  misc_feature 1..659: note = Synthetic polypeptide
  source 1..659: mol_type = other DNA
gccaggtccgtcggaagttagagctggaagctgctgtgacccgcctgcgggcagaaatccaggaactcgaccagagcctggagctgatggagcgagacactgaggctcaggacacggccatggagcaggcacgtcagcacactcaagacacccagcgtcgagctctcctcctccgggcccaagctggggccatgcgaagacagcagcatacgctccgagatcccatgcagcggctgcagaatcaactgaggcgcctgcaggacatggagaggaaagccaaagtagatgtgacctttggatccctcacgtcggcagctctgggcctggagcccgtggtcctgcgtgatgtccgaacagcctgcaccctccgggcccagttcctgcagaacctcctgcttccccaggccaagaggggcagcctcccaacccctcatgatgaccactttggcacttcgtaccagcagtggctgagctcagtggagacgctgctgacaaaccaccccccaggccacgtcctggctgccttggagcacctggctgcagagcgggaggcagagattcggtccctgtgcagtggggatgggcttggcgacacagagatatccaggagggctggcggactgtgggtgtgctggtctcccagcggagcaccctcctga

SEQ ID NO: 7474 - DNA, 1688 bp, synthetic construct
  misc_feature 1..1688: note = Synthetic polypeptide
  source 1..1688: mol_type = other DNA
gccaggtccgtcggaagttagagctggaagctgctgtgacccgcctgcgggcagaaatccaggaactcgaccagagcctggagctgatggagcgagacactgaggctcaggacacggccatggagcaggcacgtcagcacactcaagacacccagcgtcgagctctcctcctccgggcccaagctggggccatgcgaagacagcagcatacgctccgagatcccatgcagcggctgcagaatcaactgaggcgcctgcaggacatggagaggaaagccaaagtagatgtgacctttggatccctcacgtcggcagctctgggcctggagcccgtggtcctgcgtgatgtccgaacagcctgcaccctccgggcccagttcctgcagaacctcctgcttccccaggccaagaggggcagcctcccaacccctcatgatgaccactttggcacttcgtaccagcagtggctgagctcagtggagacgctgctgacaaaccaccccccaggccacgtcctggctgccttggagcacctggctgcagagcgggaggcagagattcggtccctgtgcagtggggatgggcttggcgacacagagatatccagaccccaggccccggaccagtcagactccagccagaccctgccgtccatggttcatctcatccaggagggctggcggactgtgggtgtgctggtctcccagcggagcaccctcctgaaggagcggcaagtcttgacccagcgcctccagggcctggtggaggaggtggagagacgcgtcctgggatccagtgagaggcaggtgctgatactggggcttcggcgctgttgcctgtggacggagctcaaggccctgcacgatcagagccaggagctgcaggatgcagctgggcatcggcagctcctgctgagggagctacaggccaaacagcagcggatcctgcactggcgccagctggtggaggagacccaggaacaggtccgcctgctcatcaagggaaactcggccagcaagacccgcctgtgccggagcccgggggaggtgctagctctggtccagcgaaaggtggtccctacatttgaggcagtggcaccacagagccgggagctgctgcgctgtctggaggaggaagtccggcatttgccccacattctgttgggcacgctgctgcggcacaggccgggagagttgaagcccctgcccacggtcctcccatccatccaccagctgcaccccgcgtccccaaggggctccagcttcatagcgctgagccacaagctggggctgcctccagggaaggcctcggagctgctcctgccggcggctgcctctcttcgccaggaccttctgctcctgcaggaccagcggagcctctggtgctgggatctactccacatgaagaccagcctgccgccaggccttcccacccaggagctgctgcagatccaggcatcccaggaaaaacagcagaaagagaacctggggcaggctctgaagaggctggagaagctactgaaacaggcactggagcgaatccctgagctgcaggggatcgtgggggactggtgggagcagccaggccaggccgccctctctgaggagctctgccagggcctgtccctgccccagtggcggctgcgctgggttcaggcccagggggccctgcagaagctgtgcagctga

SEQ ID NO: 7475 - DNA, 772 bp, synthetic construct
  misc_feature 1..772: note = Synthetic polypeptide
  source 1..772: mol_type = other DNA
tgtgatactgtgaaatatatatttggtattctgccctcattttctggcgtacaactcctgaaatccttaggatctccaaaatgataagttctctttgtgctgtgaatgactgacagctggcagcccctaggcagcttcaggttgaggctgctcactggaatgacagatgcaggattcgagggttgggactttcagccccacccatacctctggggaagggaaaggggctgaagttaagttgatggctgatggtttaatcaatcttgcctacataatgaagcctctataaaaacccaaacaaggattggctggagagcttccaggtagctgaacacttggaggttcctggagggtgtggtgctccaaggaggacatggaagctccacgtcccttttccccatacctccctacaggcctcttcgatttgtgaactggtacacctctgtgtttccccgagttctgtgagctgcgctaattgaatcccaagaggaggctgtgggaaccccaactcgaagccgattggtcagaagttccggaggtcctgtgactggtatctgagaatgctgagatgtataaactgtcttcagagcaattccatgaggcagcctcaaagatggagagcacaataaagccccgcagggtggagcccgtctgctcagggttgcaggcccagattctccactgctaccgagatcgcccgcatgaggtgctgctgtgctcggacctggtcaaggcataccagcgctgcgtgagcgccgcccacaagggctga

SEQ ID NO: 7476 - DNA, 832 bp, synthetic construct
  misc_feature 1..832: note = Synthetic polypeptide
  source 1..832: mol_type = other DNA
tgtgatactgtgaaatatatatttggtattctgccctcattttctggcgtacaactcctgaaatccttaggatctccaaaatgataagttctctttgtgctgtgaatgactgacagctggcagcccctaggcagcttcaggttgaggctgctcactggaatgacagatgcaggattcgagggttgggactttcagccccacccatacctctggggaagggaaaggggctgaagttaagttgatggctgatggtttaatcaatcttgcctacataatgaagcctctataaaaacccaaacaaggattggctggagagcttccaggtagctgaacacttggaggttcctggagggtgtggtgctccaaggaggacatggaagctccacgtcccttttccccatacctccctacaggcctcttcgatttgtgaactggtacacctctgtgtttccccgagttctgtgagctgcgctaattgaatcccaagaggaggctgtgggaaccccaactcgaagccgattggtcagaagttccggaggtcctgtgactggtatctgagaatgctgagatgtataaactgtcttcagagcaattccatgaggcagcctcaaagatggagagcacaataaagccccgcagggtggagcccgtctgctcagggttgcaggcccagattctccactgctaccgagatcgcccgcatgaggtgctgctgtgctcggacctggtcaaggcataccagcgctgcgtgagcgccgcccacaaggtaaggccttgcctgcctcccaggtttccaagggccttgggaggtaggcgaggtacctctatctag

SEQ ID NO: 7477 - DNA, 763 bp, synthetic construct
  misc_feature 1..763: note = Synthetic polypeptide
  source 1..763: mol_type = other DNA
tgtgatactgtgaaatatatatttggtattctgccctcattttctggcgtacaactcctgaaatccttaggatctccaaaatgataagttctctttgtgctgtgaatgactgacagctggcagcccctaggcagcttcaggttgaggctgctcactggaatgacagatgcaggattcgagggttgggactttcagccccacccatacctctggggaagggaaaggggctgaagttaagttgatggctgatggtttaatcaatcttgcctacataatgaagcctctataaaaacccaaacaaggattggctggagagcttccaggtagctgaacacttggaggttcctggagggtgtggtgctccaaggaggacatggaagctccacgtcccttttccccatacctccctacaggcctcttcgatttgtgaactggtacacctctgtgtttccccgagttctgtgagctgcgctaattgaatcccaagaggaggctgtgggaaccccaactcgaagccgattggtcagaagttccggaggtcctgtgactggtatctgagaatgctgagatgtataaactgtcttcagagcaattccatgaggcagcctcaaagatggagagcacaataaaggtggagcccgtctgctcagggttgcaggcccagattctccactgctaccgagatcgcccgcatgaggtgctgctgtgctcggacctggtcaaggcataccagcgctgcgtgagcgccgcccacaagggctga

SEQ ID NO: 7478 - DNA, 557 bp, synthetic construct; identical to SEQ ID NO: 6591
  misc_feature 1..557: note = Synthetic polypeptide
  source 1..557: mol_type = other DNA

SEQ ID NO: 7479 - DNA, 852 bp, synthetic construct; identical to SEQ ID NO: 753
  misc_feature 1..852: note = Synthetic polypeptide
  source 1..852: mol_type = other DNA

SEQ ID NO: 7480 - DNA, 1691 bp, synthetic construct
  misc_feature 1..1691: note = Synthetic polypeptide
  source 1..1691: mol_type = other DNA
tggaacagtggaaagaacttgtccttgtcctgggaatcaaaagatgtgaatcttgatttctactaaagatgaccctaggatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaa

SEQ ID NO: 7481 - DNA, 1727 bp, synthetic construct
  misc_feature 1..1727: note = Synthetic polypeptide
  source 1..1727: mol_type = other DNA
tggaacagtggaaagaacttgtccttgtcctgggaatcaaaagatgtgaatcttgatttctactaaagatgaccctaggatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttagcaactactctaaaatcttatgattcaaacaccccaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaa

SEQ ID NO: 7482 - DNA, 629 bp, synthetic construct
  misc_feature 1..629: note = Synthetic polypeptide
  source 1..629: mol_type = other DNA
tggaacagtggaaagaacttgtccttgtcctgggaatcaaaagatgtgaatcttgatttctactaaagatgaccctaggatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggttggcttttacaaacccctaagcttcttctttacctttccttaaaatttcaaccttctcttttcttactctataattga

SEQ ID NO: 7483 - DNA, 1553 bp, synthetic construct
  misc_feature 1..1553: note = Synthetic polypeptide
  source 1..1553: mol_type = other DNA
tggaacagtggaaagaacttgtccttgtcctgggaatcaaaagatgtgaatcttgatttctactaaagatgaccctaggatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttagcaactactctaaaatcttatgattcaaacaccccaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaa

SEQ ID NO: 7484 - DNA, 868 bp, synthetic construct
  misc_feature 1..868: note = Synthetic polypeptide
  source 1..868: mol_type = other DNA
gtttttaactgttgggctacatcacactctcctgaggatgcttaaaaccctacgcatattggagcctccgctaatccgatcagaatatctgcagcactatgttggccatggaaatgctatcaatgagctgaaattccatccaagagatccaaatcttctcctgtcagtaagtaaagatcatgctttacgattatggaatatccagacggacactctggtggcaatatttggaggcgtagaagggcacagagatgaagttctaagtgctgattatgatcttttgggtgaaaaaataatgtcctgtggtatggatcattctcttaaactttggaggatcaattcaaagagaatgatgaatgcaattaaggaatcttatgattataatccaaataaaactaacaggccatttatttctcagaaaatccattttcctgatttttctaccagagacatacataggaattatgttgattgtgtgcgatggttaggcgatttgatactttctaagtcttgtgaaaatgccattgtgtgctggaaacctggcaagatggaagatgatatagataaaattaaacccagtgaatctaatgtgactattcttgggcgatttgattacagccagtgtgacatttggtacatgaggttttctatggatttctggcaaaagatgcttgcattgggcaatcaagttggcaaactttatgtttgggatttagaagtagaagatcctcataaagccaaatgtacaacactgactcatcataaatgtggtgctgctattcgacaaaccagttttagcagggatagcagcattcttatagctgtttgtgatgatgccagtatttggcgctgggatcgacttcgataa

SEQ ID NO: 7485 - DNA, 628 bp, synthetic construct
  misc_feature 1..628: note = Synthetic polypeptide
  source 1..628: mol_type = other DNA
gtttttaactgttgggctacatcacactctcctgaggatgcttaaaaccctacgcatattggagcctccgctaatccgatcagaatatctgcagcactatgttggccatggaaatgctatcaatgagctgaaattccatccaagagatccaaatcttctcctgtcagtaagtaaagatcatgctttacgattatggaatatccagacggacactctggtggcaatatttggaggcgtagaagggcacagagatgaagttctaagtgcttcttgtgaaaatgccattgtgtgctggaaacctggcaagatggaagatgatatagataaaattaaacccagtgaatctaatgtgactattcttgggcgatttgattacagccagtgtgacatttggtacatgaggttttctatggatttctggcaaaagatgcttgcattgggcaatcaagttggcaaactttatgtttgggatttagaagtagaagatcctcataaagccaaatgtacaacactgactcatcataaatgtggtgctgctattcgacaaaccagttttagcagggatagcagcattcttatagctgtttgtgatgatgccagtatttggcgctgggatcgacttcgataa

SEQ ID NO: 7486 - DNA, 745 bp, synthetic construct
  misc_feature 1..745: note = Synthetic polypeptide
  source 1..745: mol_type = other DNA
gtttttaactgttgggctacatcacactctcctgaggatgcttaaaaccctacgcatattggagcctccgctaatccgatcagaatatctgcagcactatgttggccatggaaatgctatcaatgagctgaaattccatccaagagatccaaatcttctcctgtcagtaagtaaagatcatgctttacgattatggaatatccagacggacactctggtggcaatatttggaggcgtagaagggcacagagatgaagttctaagtgctgattatgatcttttgggtgaaaaaataatgtcctgtggtatggatcattctcttaaactttggaggatcaattcaaagagaatgatgaatgcaattaaggaatcttatgattataatccaaataaaactaacaggccatttatttctcagaaaatccattttcctgatttttctaccagagacatacataggaattatgttgattgtgtgcgatggttaggcgatttgatactttctaagtcttgtgaaaatgccattgtgtgctggaaacctggcaagatggaagatgatatagataaaattaaacccagtgaatctaatgtgactattcttgggcgatttgattacagccagtgtgacatttggtacatgaggttttctatggatttctggcaaaagatgcttgcattgggcaatcaagttggcaaactttatgtttgggatttagaagtagaagatcctcataaagccaagtaa

SEQ ID NO: 7487 - DNA, 943 bp, synthetic construct
  misc_feature 1..943: note = Synthetic polypeptide
  source 1..943: mol_type = other DNA
gtttttaactgttgggctacatcacactctcctgaggatgcttaaaaccctacgcatattggagcctccgctaatccgatcagaatatctgcagcactatgttggccatggaaatgctatcaatgagctgaaattccatccaagagatccaaatcttctcctgtcagtaagtaaagatcatgctttacgattatggaatatccagacggacactctggtggcaatatttggaggcgtagaagggcacagagatgaagttctaagtgctgattatgatcttttgggtgaaaaaataatgtcctgtggtatggatcattctcttaaactttggaggatcaattcaaagagaatgatgaatgcaattaaggaatcttatgattataatccaaataaaactaacaggccatttatttctcagaaaatccattttcctgatttttctaccagagacatacataggaattatgttgattgtgtgcgatggttaggcgatttgatactttctaagagtggccgtgccattttacattcccaccagcaatgtatgagagatccagtgtctccgaatcttcgccagcatttgtcttgtgaaaatgccattgtgtgctggaaacctggcaagatggaagatgatatagataaaattaaacccagtgaatctaatgtgactattcttgggcgatttgattacagccagtgtgacatttggtacatgaggttttctatggatttctggcaaaagatgcttgcattgggcaatcaagttggcaaactttatgtttgggatttagaagtagaagatcctcataaagccaaatgtacaacactgactcatcataaatgtggtgctgctattcgacaaaccagttttagcagggatagcagcattcttatagctgtttgtgatgatgccagtatttggcgctgggatcgacttcgataa

SEQ ID NO: 7488 - DNA, 1582 bp, synthetic construct
  misc_feature 1..1582: note = Synthetic polypeptide
  source 1..1582: mol_type = other DNA
tctccctctccctccccgtttccctctccctccccgtctctgtctcccactttccacggtctccctctgatgccgagcccaaggtggactgtactgccgccatctcggctcactgcagcctccctgcctgattctcctgcctcagcctgcccagtgcctgggattgcaggcgcgtgccgccacgcctgactggtttttgtattttttggtggagaccgagttttgccgtgttggccgggctggtctccagctcctgaccgcgagtgatctgcccgcctcggcctcctgaggtgccgggattgcaggcggagtctcgctcactcagtgctcaatgttgcccaggctggagtgcagtggcgtgatctcggctagctacaacctccacctcccagccgcctgccttggcctcccaaagcgccgagattgcagcctctgcccggccgccaccccgtctgggaagtgaggagcgtctctgcctggccgcccatcgtctgggatgtgaggagcccctctgcccggccgcccagtctgggaagtgaggatcgcctcttcccggccgccatcccgtctgggaagtgaggagcgtctctgcccggtcgcccgtcgtctgagatgtggggagcgcctctgccccgcggccctgtctgggatgtgaggagtgcctctgcccggctgcgaccccgtctgggaactgaggagtgtctctgccagaccgccaccccgtctgggagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttga

SEQ ID NO: 7489 - DNA, 1007 bp, synthetic construct
  misc_feature 1..1007: note = Synthetic polypeptide
  source 1..1007: mol_type = other DNA
ccctccccctccccctccccctctccctcaccctctccctctccccacggtctccctctgatgccaagccaaagctggactgtactgctgccatctcggctcactgcaacctccctgcctgattctcctgcctcagcctgcccagtgcctgtgattgcaggcgcgcgccgccacgcctgactggttttggtggagacggggtttcgctgtgttggccgggccggtctccagcccctaaccacgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcatctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccatctgagaagtgaggagcctctccgcccggcagccaccccatctgggaaacaggatcttgctacattgcccaggctggcctcgaactcctggcttcaagtgatcttcccgcctcggcctcccagagtgctgggataacaggtgtgagccaccatacccaaccagctttattactgatttccctctaa

SEQ ID NO: 7490 - DNA, 304 bp, synthetic construct
  misc_feature 1..304: note = Synthetic polypeptide
  source 1..304: mol_type = other DNA
actgcagagcacagtcatcaagagcatgagctctagagccaaatctcatctccccacttcacggctgggtgaacttcaggcctcagtctccacatttgtaaaatgatgagaagcatacctgctctaggaggttgtcaggagtcaactgacaacagtgagctgggacggagacaagctccagtgtgtgcagaagggtgagaaggaggggcgtggctggacccagtggatcgagggtgatgagctgcacctggagatgagagtggaaggtgtggtctgcaagcaagtattcaagaaggtgcagtga

SEQ ID NO: 7491 - DNA, 1931 bp, synthetic construct
  misc_feature 1..1931: note = Synthetic polypeptide
  source 1..1931: mol_type = other DNA
ctctccctctccccctccccctccccctctccctctccccacggtctccctctccctctctttccagggtctccctctgatgcccagccgaagctggactgtactgctgccatctcggctcactgcaacctccccgcctgattctcctgcctcagcctgcagagtgcctgccattgcaggcacgcgccgccacgcctgactggttttcgtatttttttggtggagatggggtttcgctgtgttggccgggctagtctccagctcctaaccgcgagtgatccgccagcctcggcctccggaggtgccgggattgcagacggtgtctggttcaatcagtgctcaatggtgcccaggctggaatgcagtggcgtgatctcggctcgctacaacctccacctcccagccacctgccttggcctcccaaagtgccgagagtgcagcctctgcccggccgccaccccgtctgggaagtgaggagcgtctctgcctggccgcctatcgtctgggacgtgaggagcccctctgcgtggctgcccagtctggaaagtgaggagcgtctctgcccggtcgccatcccatctaggaagtgaggagcgcctcttcccggccgccatcccatctaggaagtgaggagcatctctgcctggccgcccttcttctgagatgtggggagcgcctttgccccaccgccctgtctgggatgtgaggagcgcctctgccaggccgcgaccccgtctgggaggtgaggagcgtctctgcccagccgccccgtctgagaagggaggagaccctccgcccggcaaccgccccgtctcagaagaaccagtagatcctctaaaggaagaagccttattggtaaggttgatggcacatcccacgtcactggaaaaggagttacagttgaaacagtcttttctgtggatgagttttctgcatctgtcctcactggaaaactgaccactgtcttccttccaattgtctacacaattgtgtttgtggtgggtttgccaagtaacggcatggccctgtgggtctttcttttccgaactaagaagaagcaccctgctgtgatttacatggccaatctggccttggctgacctcctctctgtcatctggttccccttgaagattgcctatcacatacatggcaacaactggatttatggggaagctctttgtaatgtgcttattggctttttctatggcaacatgtactgttccattctcttcatgacctgcctcagtgtgcagaggtattgggtcatcgtgaaccccatggggcactccaggaagaaggcaaacattgccattggcatctccctggcaatatggctgctgattctgctggtcaccattcctttgtatgtcgtgaagcagaccatcttcattcctgccctgaacatcacgacctgtcatgatgttttgcctgagcagctcttggtgggagacatgttcaattacttcctctctctggccattggggtctttctgttcccagccttcctcacagcctctgcctatgtgctgatgatcagaatgctgcgatcttctgccatggatgaaaactcagagaagaaaaggaagagggccatcaaactcattgtcactgtcctggccatgtacctgatctgcttcactcctagtaaccttctgcttgtggtgcattattttctgattaagagccagggccagagccatgtctatgccctgtacattgtagccctctgcctctctacccttaacagctgcatcgacccctttgtctattactttgtttcacatgatttcagggatcatgcaaagaacgctctcctttgccgaagtgtccgcactgtaaagcagatgcaagtatccctcacctcaaagaaacactccaggaaatccagctcttactcttcaagttcaaccactgttaagacctcctattga

SEQ ID NO: 7492 - DNA, 233 bp, synthetic construct; identical to SEQ ID NO: 856
  misc_feature 1..233: note = Synthetic polypeptide
  source 1..233: mol_type = other DNA

SEQ ID NO: 7493 - DNA, 2322 bp, synthetic construct
  misc_feature 1..2322: note = Synthetic polypeptide
  source 1..2322: mol_type = other DNA
aagttaaacatggaatagctatgtgactcagcaattccaaggtaagatgtaaaagaattgaaaagaagcattcaaacaaatacttctacacaaatgttcacagcagcagcagcagcactatttgtaataaccaaaaggtagaaacaagccaagtgttcatcaactgatgagtaggtaaacaaaatgtggtctatccatacaatggaatgttattgtatgaagtgctgatacatgctgtgacatggatcagccttgaaagtatgatgctaaatgaaagacaccagacacgaaagtcacgtgttgtatgatgccatttctatggaatgtccagcataggcaagtccacagatacagagtaaactggtggttttcaaggcctggagagagacggagtggctgcttaatagctacattgtcacaggtgacattaaggggaacattaagttctatgatcacaccctgtctattgttaactggtacagtcacttgaaactgggcgccataagaactctgtccttttcaaagaccccagcaactcctcctactgaaaaatcaaactatcctcctgactgcactttaaaaggtgacctttttgtcttaaggaattttatcattggaacatctgatgccgcggtgtaccacttaacaacagatgggaccaaacttgagaagttatttgtagagcccaaggatgccatttgtgccatctcctgccacccatatcaacccctcattgccatcgggagcatctgtgggatgatcaaagtgtggaattatgaaaacaaacaatatcttttcagcagggtttttgagaaggggcttggagtccagagtctgacctacaaccccgaaggagcccttcttggagctggctttacagaggggacagtttacattcttgatgcaatgtctttagaaaatgaaagcccagagcctttcaaatattccagaaccagtgtgactcatataagcttttcccatgactcccagtatatggcaactgctgatagaagttttactgtggctgtttacatgctggtggtcagaaatggacagagggtctgggagtacttagcaagacttcgctctcatcgcaaaagcattcgaagtctcctgtttggggtttacctggacagcaatgagcctagactgctgagccttgggacagacaggctcttgatagagtatgatcttctcaggagctacaaagaccacctggaagtcctggacattcaccacaccgaccagggctgctatcccacctgcatggtctggtacccaccactcaccagggaactcttcctgcttatttgcaacagtggctacaaagtgaagctttttaatgctactaccaaaatgtgcagaaagacgcttctggggccagcttatggttcccctattgagcagacacaagtcctcccagtgagaagcatggcggagctacagaaacgctacttggtgtttattaacagagacaaggtgggacttcagatcttaccagttgacggcaatccacataagacatctgctattgtttgccacccgaacggggtggccggcatggccgtttcctatgatggctgctacgccttcactgcgggagggcacgatcgctcggtggtgcagtggaaaatcaccttaagtgtcctggaggcagcggtttctcttgggggtgaagacttgaccccattctatggtctgctgtctggtggccgggaaggaaaattctacagggagctagaagactacttctactattctcagctccgcagtcaaggcatcgacacaatggagaccagaaaggtgtcagaacacatttgcctgtcagagcttccttttgtcatgagagcaattggcttttacccatctgaagagaagattgatgatatatttaacgaaatcaaatttggtgaatatgtggacactggaaagctaatcgacaagatcaacttaccagatttcctaaaagtgtaccttaaccacaagccaccttttggtaacaccatgagtggcatccacaagagctttgaggtgctcggttataccaactccaaagggaaaaaggccattcgaagagaggacttcctgagactgctcgttactaaaggtgagcatatgacggaggaggagatgttggattgctttgcttcactgtttggcctgaatcccgagggatggaaatccgagcctgcaacctgctccgtcaaaggttcagaaatttgccttgaagaagaacttccagacgaaatcactgcagaaatattcgcgactgaaattcttggcttaaccatttcagaagattccggccaggatggtcagtga

SEQ ID NO: 7494 - DNA, 1698 bp, synthetic construct
  misc_feature 1..1698: note = Synthetic polypeptide
  source 1..1698: mol_type = other DNA
aagttaaacatggaatagctatgtgactcagcaattccaaggtaagatgtaaaagaattgaaaagaagcattcaaacaaatacttctacacaaatgttcacagcagcagcagcagcactatttgtaataaccaaaaggtagaaacaagccaagtgttcatcaactgatgagtaggtaaacaaaatgtggtctatccatacaatggaatgttattgtatgaagtgctgatacatgctgtgacatggatcagccttgaaagtatgatgctaaatgaaagacaccagacacgaaagtcacgtgttgtatgatgccatttctatggaatgtccagcataggcaagtccacagatacagagtaaactggtggttttcaaggcctggagagagacggagtggctgcttaatagctacattgtcacaggtgacattaaggggaacattaagttctatgatcacaccctgtctattgttaactggtacagtcacttgaaactgggcgccataagaactctgtccttttcaaagaccccagcaactcctcctactgaaaaatcaaactatcctcctgactgcactttaaaaggtgacctttttgtcttaaggaattttatcattggaacatctgatgccgcggtgtaccacttaacaacagatgggaccaaacttgagaagttatttgtagagcccaaggatgccatttgtgccatctcctgccacccatatcaacccctcattgccatcgggagcatctgtgggatgatcaaagtgtggaattatgaaaacaaacaatatcttttcagcagggtttttgagaaggggcttggagtccagagtctgacctacaaccccgaaggagcccttcttggagctggctttacagaggggacagtttacattcttgatgcaatgtctttagaaaatgaaagcccagagcctttcaaatattccagaaccagtgtgactcatataagcttttcccatgactcccagtatatggcaactgctgatagaagttttactgtggctgtttacatgctggtggtcagaaatggacagagggtctgggagtacttagcaagacttcgctctcatcgcaaaagcattcgaagtctcctgtttggggtttacctggacagcaatgagcctagactgctgagccttgggacagacaggctcttgatagagtatgatcttctcaggagctacaaagaccacctggaagtcctggacattcaccacaccgaccagggctgctatcccacctgcatggtctggtacccaccactcaccagggaactcttcctgcttatttgcaacagtggctacaaagtgaagctttttaatgctactaccaaaatgtgcagaaagacgcttctggggccagcttatggttcccctattgagcagacacaagtcctcccagtgagaagcatggcggagctacagaaacgctacttggtgtttattaacagagacaaggtgggacttcagatcttaccagttgacggcaatccacataagacatctgctattgtttgccacccgaacggggtggccggcatggccgtttcctatgatggctgctacgccttcactgcgggagggcacgatcgctcggtggtgcagtggaaaatcaccttaagccatcctgggagccaggcaccaatattatccccatcagacacatcaagaagctaa

SEQ ID NO: 7495 - DNA, 588 bp, synthetic construct
  misc_feature 1..588: note = Synthetic polypeptide
  source 1..588: mol_type = other DNA
ataatatatgcaaaatgactttataaactaaagctttggagttatgcctgagttccagtgatggttcttagctcttcatggttctgttcttagctattgactgcaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataa

SEQ ID NO: 7496 - DNA, 400 bp, synthetic construct; identical to SEQ ID NO: 749
  misc_feature 1..400: note = Synthetic polypeptide
  source 1..400: mol_type = other DNA

SEQ ID NO: 7497 - DNA, 2301 bp, synthetic construct; identical to SEQ ID NO: 750
  misc_feature 1..2301: note = Synthetic polypeptide
  source 1..2301: mol_type = other DNA

SEQ ID NO: 7498 - DNA, 2381 bp, synthetic construct; identical to SEQ ID NO: 751
  misc_feature 1..2381: note = Synthetic polypeptide
  source 1..2381: mol_type = other DNA

SEQ ID NO: 7499 - DNA, 692 bp, synthetic construct; identical to SEQ ID NO: 752
  misc_feature 1..692: note = Synthetic polypeptide
  source 1..692: mol_type = other DNA

SEQ ID NO: 7500 - DNA, 811 bp, synthetic construct
  misc_feature 1..811: note = Synthetic polypeptide
  source 1..811: mol_type = other DNA
cagccgcctgccttggcctcccaaagtgccgagattgcagcctctgcccggctgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaagatggggacccagacacgccaaagcctgtgagcttcacagtgaaggagacagtgtgccccaggacgacacagcagtcaccagaggattgtgacttcaagaaggacgggctggtgaagcggtgtatggggacagtgaccctcaaccaggccaggggctcctttgacatcagttgtgataaggataacaagagatttgccctgctgggtgatttcttccggaaatctaaagagaagattggcaaagagtttaaaagaattgtccagagaatcaaggattttttgcggaatcttgtacccaggacagagtcctag

SEQ ID NO: 7501 - DNA, 2171 bp, synthetic construct
  misc_feature 1..2171: note = Synthetic polypeptide
  source 1..2171: mol_type = other DNA
ggctgggcgcggtggctcacacctgcaatcccagcactttgggacgccgaggcgggtggatcacctaaggtcgagagttcaagaccaggctgaccattatggagaaaccccgtctctactaaaaatacagaaaattagctgggtatggtgacgcttgcctgtaatcccagctacgccggaggctgaggcgggagaaccgcttgaacccaggaggcagaggttgcggtggcctgagatcgtgccattgcactccagcctggataactaagaaattcgtcaaaggctctacagagaagaacaagctcagactgcaaagagatcaggagcgtctgggcaagcagctcaagttacgtgcagaaagggaagaaaaggagaagctgaaagaggaggccaagcgggccaaggaggaggccaagaagaagaaggaggaagagaaggagcttaaggaaaaggagaggcgggagaagcgggagaaggatgagaaggagaaggcggagaagcagcggctcaaggaggagcggcgcaaggagagacaggaagccctggaggctaaacttgaggaaaaaaggaaaaaggaagaagagaaacggttaagagaagaagagaagcgcattaaagcagagaaggccgaaatcacgaggttcttccagaaaccaaagactccacaggcccccaagaccctggccggctcctgtgggaagtttgccccctttgaaattaaagagcacatggtcctggcccctcggcgtcggaccgctttccatccagacctctgcagtcagctggaccagctcctccagcagcagagcggcgagttctccttcttgaaagacctcaaaggccggcagcccctgaggtccggacccacgcacgtttccacccggaatgcagatatttttaacagtgatgtcgtcatcgtggagcgtgggaagggcgacggtgttcccgagaggaggaagtttggcaggatgaagctcctgcagttctgtgagaaccaccggcctgcctactggggtacctggaataagaagacggcactcatccgcgcgcgagacccctgggcccaggacacgaagctcctggactatgaggtggacagtgatgaggagtgggaagaagaggagcctggggagtccctgtcccacagtgagggggatgatgatgacgacatgggagaggatgaagatgaggacgatggtttctttgtgccccatgggtacctgtctgaggacgaaggtgtgacagaggagtgtgccgaccctgagaaccataaggtccgccagaaactgaaggccaaggagtgggacgagttcctggctaaggggaagcgctttcgcgtcctgcaacctgtgaagatcggctgcgtgtgggcggctgacagagactgcgcaggcgatgacctgaaggtactgcagcagttcgcagcctgcttcctggagaccctgccggcccaggaggagcagacgcccaaggcctccaagcgggagaggagagacgagcagatcctggcccagctgctgccgctcctgcacggcaatgtgaacgggagcaaggtcatcatccgggagttccaggagcactgccgccggggactgctcagcaaccacaccggcagcccgcggagcccctccaccacctacctgcacacccccacccccagcgaggatgccgccatcccctctaagtcccggctcaagcggctcatttccgagaactcagtgtatgagaagcggcctgacttcaggatgtgctggtacgtgcacccgcaggtgctacagagcttccagcaggagcacctgcccgtgccgtgccagtggagctatgtgacatcggtgccctcggcccccaaagaggacagtggcagcgtcccctccacggggcccagccagggcactcccatctcgctgaagaggaagtcagcgggcagcatgtgcatcacccaattcatgaagaagcgcaggcacgacggccagattggtgctgaagacatggacggcttccaggcagacacggaggaggaggaagaggaggagggcgactgtatgatcgtggatgtcccggatgctgcggaggtccaagccccgtgtggagccgcttccggagctgggggtggtgtgggggtggacaccggcaaggccaccctgacctcgagcccactgggtgcatcctga

SEQ ID NO: 7502 - DNA, 364 bp, synthetic construct
  misc_feature 1..364: note = Synthetic polypeptide
  source 1..364: mol_type = other DNA
atctggaggacactaactggaagaaagcataggcatccttaattgttgagaggacagaactggtacctgtgggtagctactatgtgaatggagatgtcagcttggtatgagaatttcataatggtagaacaagggaacctcagaacctgttctggatccacagcaaatccaagcatttgatcagctttgccgtctctaccgaggaagctccaggctggctctcctcacggaactctcccagaatcgcagcagcgagagctataggccattcagtggctcgcagagtgctcctgctttcaacagcatcttccagaatgagaacttccagctgcagctcattcctccacctgtgactgaggattga

SEQ ID NO: 7503 - DNA, 713 bp, synthetic construct
  misc_feature 1..713: note = Synthetic polypeptide
  source 1..713: mol_type = other DNA
tgtctccccagatcatcttctcccattcttctcccactcctaccagatttatgccctccctgctccactggaactgccctggccaacctcaccagtgacctccatgtcgcccaatccaagaggccctctacacagagacaaggctgcagtttgacgagacagccaagcacctccagaagctggaaagcaccaccagaaaggcagtttgtgcatctgtgaaagacttcaacaagagccaggccatcgagtcagtggaaaggaaaaagcaagagaaaaagcaagaacaagaggacaacttggccgagatcaccaacctcctgcgtggggacctgctctccgagaacccgcagcaggcagccagctccttcgggccccaccgcgtggtccctgaccgctggaagggcatgacccaggagcagctggagcagatccgcctagtccagaagcagcaaatccaggagaagctgaggctccaggaagaaaagcgccagcgagacctggactgggaccggcggaggattcagggggctcgcgccaccctgctgtttgagcggcagcagtggcggcggcagcgcgacctgcgcagagctctggacagcagcaacctcagcctggccaaggagcagcatttgcagaaaaaatatatgaatgaagtctatacaaatcaacccacgggagactatttcacacaatttaatacaggaagtcgataa

SEQ ID NO: 7504 - DNA, 331 bp, synthetic construct
  misc_feature 1..331: note = Synthetic polypeptide
  source 1..331: mol_type = other DNA
tgtctcgcccagcgcacttctgagcccccagagggccagcccgcacatcaacgagctgactatgaagctgagcgtggaggacgtgctgacccgcgccgaggccctgcaccgccagctaaccgcctgccccgagctgccccacaacgtgcaggagatcctggggctggccccgcccgcagagccccacagcccctcgcccaccgcctccccgctgcctctgtcgcccacccgggccccgcccaccccgccgccctccacggacacagccccgcagcccgacagcagcctggagatcctgcccgaggaggaggacgagggcgccgactcctaa

SEQ ID NO: 7505 - DNA, 171 bp, synthetic construct
  misc_feature 1..171: note = Synthetic polypeptide
  source 1..171: mol_type = other DNA
gccggatgtggtggttcatgcctgtaatcccagctactcgggaggctgaggcaagagaatcgcttgaactcaggaggcagaggttgcagtgagctgagattgccccactgaactccagcctgcgcgataagagtggacattgaagtggacctaattcggttttccttttaa

SEQ ID NO: 7506 - DNA, 308 bp, synthetic construct
  misc_feature 1..308: note = Synthetic polypeptide
  source 1..308: mol_type = other DNA
ggccgggcgcggtgcctcacgccttgtaatcccttcactttgggagatcaaggcggggggaatcacctgaggtcgggagttcgagaccagcctggccaacaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctga

SEQ ID NO: 7507 - DNA, 423 bp, synthetic construct
  misc_feature 1..423: note = Synthetic polypeptide
  source 1..423: mol_type = other DNA
ggccgggcgcggtgcctcacgccttgtaatcccttcactttgggagatcaaggcggggggaatcacctgaggtcgggagttcgagaccagcctggccaacaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattga

SEQ ID NO: 7508 - DNA, 369 bp, synthetic construct
  misc_feature 1..369: note = Synthetic polypeptide
  source 1..369: mol_type = other DNA
ggccgggcgcggtgcctcacgccttgtaatcccttcactttgggagatcaaggcggggggaatcacctgaggtcgggagttcgagaccagcctggccaacaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacgacatccccgattgaaagaaccagagaggctctga

SEQ ID NO: 7509 - DNA, 456 bp, synthetic construct
  misc_feature 1..456: note = Synthetic polypeptide
  source 1..456: mol_type = other DNA
ggccgggcgcggtgcctcacgccttgtaatcccttcactttgggagatcaaggcggggggaatcacctgaggtcgggagttcgagaccagcctggccaacaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagaaatgatcggaaaccatttgtgggtttgtagaagcaggcatgcgtag

SEQ ID NO: 7510 - DNA, 375 bp, synthetic construct
  misc_feature 1..375: note = Synthetic polypeptide
  source 1..375: mol_type = other DNA
tgtttgttcacggtgtgtgtctgtgttactattgctaactgtgtatatcgcatttcagtgagggcaggacaaggacccaggatcgtcttggtggcagtgttccggaactttaagatcatttaccgccgctatgctggcctctacttctgcatctgtgtggatgtcaatgacaacaacctggcttacctggaggccattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtga

SEQ ID NO: 7511 - DNA, 119 bp, synthetic construct; identical to SEQ ID NO: 6582
  misc_feature 1..119: note = Synthetic polypeptide
  source 1..119: mol_type = other DNA

SEQ ID NO: 7512 - DNA, 1340 bp, synthetic construct; identical to SEQ ID NO: 7107
  misc_feature 1..1340: note = Synthetic polypeptide
  source 1..1340: mol_type = other DNA

SEQ ID NO: 7513 - DNA, 2066 bp, synthetic construct; identical to SEQ ID NO: 639
  misc_feature 1..2066: note = Synthetic polypeptide
  source 1..2066: mol_type = other DNA

SEQ ID NO: 7514 - DNA, 476 bp, synthetic construct; identical to SEQ ID NO: 646
  misc_feature 1..476: note = Synthetic polypeptide
  source 1..476: mol_type = other DNA

SEQ ID NO: 7515 - DNA, 488 bp, synthetic construct; identical to SEQ ID NO: 647
  misc_feature 1..488: note = Synthetic polypeptide
  source 1..488: mol_type = other DNA

SEQ ID NO: 7516 - DNA, 916 bp, synthetic construct
  misc_feature 1..916: note = Synthetic polypeptide
  source 1..916: mol_type = other DNA
acctggagacgaagtttccgtgcattatgaccccatgattgcgaagctggtcgtgtgggcagcagatcgccaggcggcattgacaaaactgaggtacagccttcgtcagtacaatattgttggactgcacaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataa

SEQ ID NO: 7517 - DNA, 157 bp, synthetic construct
  misc_feature 1..157: note = Synthetic polypeptide
  source 1..157: mol_type = other DNA
acctggagacgaagtttccgtgcattatgaccccatgattgcgaagctggtcgtgtgggcagcagatcgccaggcggcattgacaaaactgaggtacagccttcgtcagtacaatatcaattctctccattttcgtctagcagtggaagaagactga

SEQ ID NO: 7518 - DNA, 424 bp, synthetic construct
  misc_feature 1..424: note = Synthetic polypeptide
  source 1..424: mol_type = other DNA
acctggagacgaagtttccgtgcattatgaccccatgattgcgaagctggtcgtgtgggcagcagatcgccaggcggcattgacaaaactgaggtacagccttcgtcagtacaatattgttggactgcacaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaattga

SEQ ID NO: 7519 - DNA, 675 bp, synthetic construct
  misc_feature 1..675: note = Synthetic polypeptide
  source 1..675: mol_type = other DNA
acctggagacgaagtttccgtgcattatgaccccatgattgcgaagctggtcgtgtgggcagcagatcgccaggcggcattgacaaaactgaggtacagccttcgtcagtacaatattgttggactgcacaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactca

SEQ ID NO: 7520 - DNA, 336 bp, synthetic construct
  misc_feature 1..336: note = Synthetic polypeptide
  source 1..336: mol_type = other DNA
ttaaccctgcattgtagcacatgcctgtaatcccagcagctactcaggaggctgagacacgagaatcacttgaacctgggaagcagagtgagctgagatcacaccactccactccagcctgggcctaaagatccctcctggctgtgagctggtggtcggcggtgagccccagtgctgggctgaggggcactgtctactggtggacgactcttttctacacacagtggctcacaatggctcccccgaagatgggcctcgagtggtcttcatcgtggacctctggcaccccaacgtggcaggggctgagcgccaggccctcgactttgtcttcgcccc

SEQ ID NO: 7521 - DNA, 346 bp, synthetic construct
  misc_feature 1..346: note = Synthetic polypeptide
  source 1..346: mol_type = other DNA
ttaaccctgcattgtagcacatgcctgtaatcccagcagctactcaggaggctgagacacgagaatcacttgaacctgggaagcagagtgagctgagatcacaccactccactccagcctgggcctaaagatccctcctggctgtgagctggtggtcggcggtgagccccagtgctgggctgaggggcactgtctactggtggacgactcttttctacacacagtggctcacaatggctcccccgaagatgggcctcgagtggtcttcatcgtggacctctggcaccccaacgtggcaggggctgagcgccaggccctcgactttgtcttcgccccagacccttga

SEQ ID NO: 7522 - DNA, 776 bp, synthetic construct
  misc_feature 1..776: note = Synthetic polypeptide
  source 1..776: mol_type = other DNA
tgtagtggattgaatggtggttcacagaaagatctgtccacatcccgaagcccagaacctagaatgagactttatttgaaaataaagaactttgccggtgtaattagttagagatctagagatgagatcatcctggagtagggtaggtcctaaatccactgaccggtatccttctaaaagacagaagaggagacacagacacagaggagaagtccacgtggagacggaggcagagactggagtgatctgaccacggggtcagggactccccgagcccccagaagctgggaaaggcaggaagggttcctgccctagaagaccgtccagagagagcacgaccctgtccactcctgaatttcagacttctggtctccagaagtgcctgctactcaccccacgcagcctacgcccagagcaagctggcccttgtcctgttcacctaccacctccagcggctgctggcggctgagggaagccacgtgaccgccaacgtggtggaccccggggtggtcaacacggacgtctacaagcacgtgttctgggccacccgtctggcgaagaagcttctcggctggttgcttttcaagacccccgatgaaggagcgtggacttccatctacgcagcagtcaccccagagctggaaggagttggtggccattacctatacaacgagaaagagaccaagtccctccacgtcacctacaaccagaaactgcagcagcagctgtggtctaagagttgtgagatgactggggtccttgatgtgaccctgtga

SEQ ID NO: 7523 - DNA, 548 bp, synthetic construct
  misc_feature 1..548: note = Synthetic polypeptide
  source 1..548: mol_type = other DNA
tgtagtggattgaatggtggttcacagaaagatctgtccacatcccgaagcccagaacctagaatgagactttatttgaaaataaagaactttgccggtgtaattagttagagatctagagatgagatcatcctggagtagggtaggtcctaaatccactgaccggtatccttctaaaagacagaagaggagacacagacacagaggagaagtccacgtggagacggaggcagagactggagtgatctgaccacggggtcagggactccccgagcccccagaagctgggaaaggcaggaagggttcctgccctagaagaccgtccagagagagcacgaccctgtccactcctgaatttcagacttctggtctccagaagtgcctgctactcaccccacgcagcctacgcccagagcaagctggcccttgtcctgttcacctaccacctccagcggctgctggcggctgagggaagccacgtgaccgccaacgtggtggaccccggggtggtcaacacggacgtctacaagcacgtgttctgggccacc

SEQ ID NO: 7524 - DNA, 2781 bp, synthetic construct
  misc_feature 1..2781: note = Synthetic polypeptide
  source 1..2781: mol_type = other DNA
cctagatttaagatggtgcggctgagaccaccttcctggcagccagctgctgctgaagggaaaggcagaagtggggaagacttttttcaaaagatcatggaggaaacaaatacgcagattgcttggccatcaaaactgaagatcggagccaaatccaagaaagatccccatattaaggtttctggaaagaaagaagatgttaaagaagccaaggaaatgatcatgtctgtcttagacacaaaaagcaatcgagtcacactgaagatggatgtttcacatacagaacattcacatgtaatcggcaaaggtggcaacaatattaaaaaagtgatggaagaaaccggatgccatatccactttccagattccaacaggaataaccaagcagaaaaaagcaaccaggtatctatagcgggacaaccagcaggagtagaatctgcccgagttagaattcgggagctgcttcctttggtgctgatgtttgagctaccaattgctggaattcttcaaccggttcctgatcctaattccccctctattcagcatatatcacaaacgtacaatatttcagtatcatttaaacagcgttcccgaatgtatggtgctactgtcatagtacgagggtctcagaataacactagtgctgtgaaggaaggaactgccatgctgttagaacatcttgctgggagcttagcatcagctattcctgtgagcacacaactagatattgcagctcaacatcatctctttatgatgggtcgaaatgggagcaacatcaaacatatcatgcagagaacaggtgctcagatccactttcctgatcccagtaatccacaaaagaaatctaccgtctacctccagggcaccattgagtctgtctgtcttgcaaggcaatatctcatgggttgtcttcctcttgtgttgatgtttgatatgaaggaagaaattgaagtagatccacaattcattgcgcagttgatggaacagcttgatgtcttcatcagtattaaaccaaagcccaaacagccaagcaagtctgtgattgtgaaaagtgttgagcgaaatgccttaaatatgtatgaagcaaggaaatgtctcctcggacttgaaagcagtggggttaccatagcaaccagtccatccccagcatcctgccctgccggcctggcatgtcccagcctggatatcttagcttcagcaggccttggactcactggactaggtcttttgggacccaccaccttatctctgaacacttcaacaaccccaaactcactcttgaatgctcttaatagctcagtcagtcctttgcaaagtccaagttctggtacacccagccccacattatgggcacccccacttgctaatacttcaagtgccacaggtttttctgctataccacaccttatgattccatctactgcccaagccacattaactaatattttgttgtctggagtgcccacctatgggcacacagctccatctccccctcctggcttgactcctgttgatgtccatatcaacagtatgcagaccgaaggcaaaaaaatctctgctgctttaaatggacatgcacagtctccagatataaaatatggtgcaatatccacttcatcacttggagaaaaagtgctgagtgcaaatcacggggatccgtccatccagacaagtgggtctgagcagacatctcccaaatcaagccccactgaaggttgtaatgatgcttttgttgaagtaggcatgcctcgaagtccttcccattctgggaatgctggtgacttgaaacagatgatgtgtccctccaaggtttcctgtgccaaaaggcagacagtggaactattgcaaggcacgaaaaactcacacttacacagcactgacaggttgctctcagaccctgaactgagtgctaccgaaagccctttggctgacaagaaggctccagggagtgagcgcgctgcagagagggcagcagctgcccagcaaaactccgaaagggcccaccttgctccacggtcatcatatgtcaacatgcaggcatttgactatgaacagaagaagctattagccaccaaagctatgttaaagaaaccagtggtgacggaggtcagaacgcccacaaatacctggagtggcctgggtttttctaaatccatgccagctgaaactatcaaggagttgagaagggccaatcatgtgtcctataagcccacaatgacaaccacttatgagggctcatccatgtccctttcacggtccaacagtcgtgagcacttgggaggtggaagcgaatctgataactggagagaccgaaatggaattggacctggaagtcatagtgaatttgcagcttctattggcagccctaagcgtaaacaaaacaaatcaacggaacactatctcagcagtagcaattacatggactgcatttcctcgctgacaggaagcaatggctgtaacttaaatagctctttcaaaggttctgacctccctgagctcttcagcaaactgggcctgggcaaatacacagatgttttccagcaacaagagatcgatcttcagacattcctcactctcacagatcaggatctgaaggagctgggaataactacttttggtgccaggaggaaaatgctgcttgcaatttcagaactaaataaaaaccgaagaaagctttttgaatcgccaaatgcacgcacctctttcctggaaggtggagcgagtggaaggctaccccgtcagtatcactcagacattgctagtgtcagtggccgctggtag

SEQ ID NO: 7525 - DNA, 560 bp, synthetic construct; identical to SEQ ID NO: 6322
  misc_feature 1..560: note = Synthetic polypeptide
  source 1..560: mol_type = other DNA

SEQ ID NO: 7526 - DNA, 340 bp, synthetic construct
  misc_feature 1..340: note = Synthetic polypeptide
  source 1..340: mol_type = other DNA
ctagaattgcaatggtctcttcacagcctgccttgcctcccagatatcaggctcctgagggcagggcccatgcctgatttatgtcagtggcaagccctggagaacatcagtgaatgtttgttgagagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttag

SEQ ID NO: 7527 - DNA, 316 bp, synthetic construct
  misc_feature 1..316: note = Synthetic polypeptide
  source 1..316: mol_type = other DNA
ctagaattgcaatggtctcttcacagcctgccttgcctcccagatatcaggctcctgagggcagggcccatgcctgatttatgtcagtggcaagccctggagaacatcagtgaatgtttgttgagagagcgtgtcatcctcaggaacaccccacaagcgggactccttcatctatagcacgtggctggaggacagtgtcagcaccactagtgggggcagctccccagacgccggcaagttgggggaccctgcgtgtcccgagatcaagatccagctggaagcatctgagcagcacatgccccagctgggctgttag

SEQ ID NO: 7528 - DNA, 1002 bp, synthetic construct
  misc_feature 1..1002: note = Synthetic polypeptide
  source 1..1002: mol_type = other DNA
cagttgtctccctttatccgcagtttggctttctgcagtttcagttacctgcagtcaaccctagtctgaaaatattaaatagaaaattccagaaataaacaattcataaattttaaattatgcacctttctgagtagcatgatgaaatcctgggatattctacttcatccacgcaggatgtgagtcattcccttgtctgtctacctgctcgttagtcacttagcagcactctgggttagatcaactgtggtggtatctccgcgcttatgttcaggaacacagcctattggatccctaggctcaatatgtcctaatagttatggaagtgtgaaagatgtgtgcactgcaaaatttggctccaaacatttttttcatcttattcctaatgaagcaacaatctgcagcttgcttctctgcaacagaaatgacactgcctgggatgagctgaagctcacgtgtcagacggcactgcatgtcctgcagttaacactcaaggaaccatgggctttgttgggaggtggctgtactgaaactcatttggctgcatatatcagacacaagactcacaacgacccagaaagcattctcaaagatgatgaatgtactcaaacagaacttcaattaattgctgaagcattttgcagtgccctagaatctgttgttggctctttagaacatgatggaggtgaaattctcactgacatgaagtatggacacctttggtcagttcaggcagattctccctgtgttgctaactggccagatttgctttcacagtgtggctgtggattatacaatagccaggaagaactcaactggtctttcttaagaagcacacgtcgtccatttgtgccacaaagctgccttccacatgaagctgtgggctcagccagcaacctgaccttggactgtttgactgcaaagcttagtggcctacaggtggctgtagagacagccaatttgattttggatctttcatatgttattgaagataaaaactaa

SEQ ID NO: 7529 - DNA, 665 bp, synthetic construct; identical to SEQ ID NO: 6374
  misc_feature 1..665: note = Synthetic polypeptide
  source 1..665: mol_type = other DNA

SEQ ID NO: 7530 - DNA, 518 bp, synthetic construct; identical to SEQ ID NO: 6375
  misc_feature 1..518: note = Synthetic polypeptide
  source 1..518: mol_type = other DNA

SEQ ID NO: 7531 - DNA, 401 bp, synthetic construct
  misc_feature 1..401: note = Synthetic polypeptide
  source 1..401: mol_type = other DNA
tacatttcctagcactgcccctaaacaggtagaaacaaactacacctctgtagaaaggagcacaccgtgtatccagttcttggtttataaacactattcttcactaaagttccatggagaaattgctgattccaggtcaggggcagggaaactttgggtgatcatggattatcttttgacagaaaataaggaagtactcaaaaacgggtggacatgttgaaagaacacatgtcatcttggaaggattctcacagactacagttgggaaaatttgagcatcaaaatgaataacgtcaagaatggattataatacattgaataaaaaaggatatatgagtctatactgataaattttcttttaaattgggaaaatccatcctctcagtattggaaggaagtgg

SEQ ID NO: 7532 - DNA, 724 bp, synthetic construct
  misc_feature 1..724: note = Synthetic polypeptide
  source 1..724: mol_type = other DNA
tacatttcctagcactgcccctaaacaggtagaaacaaactacacctctgtagaaaggagcacaccgtgtatccagttcttggtttataaacactattcttcactaaagttccatggagaaattgctgattccaggtcaggggcagggaaactttgggtgatcatggattatcttttgacagaaaataaggaagtactcaaaaacgggtggacatgttgaaagaacacatgtcatcttggaaggattctcacagactacagttgggaaaatttgagcatcaaaatgaataacgtcaagaatggattataatacattgaataaaaaaggatatatgagtctatactgataaattttcttttaaattgggaaaatccatcctctcagtattggaaggaagtggcagaaaaacggagaaaggcgctgtatgaagcacttaaggaaaatgagaaacttcataaagaaattgaacaaaaggacaatgaaattgcccgcctgaaaaaggagaataaagaactggcagaagtagcagaacatgtacagtatatggcagagctaatagagagactgaatggtgaacctctggataattttgaatcactggataatcaggaatttgattctgaagaagaaactgttgaggattctctagtggaagactcagaaattggcacgtgtgctgaaggaactgtatcttcctctacggatgcaaagccatgtatatga

SEQ ID NO: 7533 - DNA, 632 bp, synthetic construct
  misc_feature 1..632: note = Synthetic polypeptide
  source 1..632: mol_type = other DNA
tacatttcctagcactgcccctaaacaggtagaaacaaactacacctctgtagaaaggagcacaccgtgtatccagttcttggtttataaacactattcttcactaaagttccatggagaaattgctgattccaggtcaggggcagggaaactttgggtgatcatggattatcttttgacagaaaataaggaagtactcaaaaacgggtggacatgttgaaagaacacatgtcatcttggaaggattctcacagactacagttgggaaaatttgagcatcaaaatgaataacgtcaagaatggattataatacattgaataaaaaaggatatatgagtctatactgataaattttcttttaaattgggaaaatccatcctctcagtattggaaggaagtggcagaaaaacggagaaaggcgctgtatgaagcacttaaggaaaatgagaaacttcataaagaaattgaacaaaaggacaatgaaattgcccgcctgaaaaaggagaataaagaactggcagaagtagcagaacatgtacagtatatggcagagctaatagagagactgaatggtgaacctctggataattttgaatcactggataatcaggaatttgattctgaagaagaaa

SEQ ID NO: 7534 - DNA, 382 bp, synthetic construct; identical to SEQ ID NO: 434
  misc_feature 1..382: note = Synthetic polypeptide
  source 1..382: mol_type = other DNA

SEQ ID NO: 7535 - DNA, 193 bp, synthetic construct
  misc_feature 1..193: note = Synthetic polypeptide
  source 1..193: mol_type = other DNA
aagggcagccatctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtg

SEQ ID NO: 7536 - DNA, 1066 bp, synthetic construct
  misc_feature 1..1066: note = Synthetic polypeptide
  source 1..1066: mol_type = other DNA
aagggcagccatctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcagcaggaatccaagcgctttgtgcagtggcagtcgtctatctga

SEQ ID NO: 7537 - DNA, 1063 bp, synthetic construct
  misc_feature 1..1063: note = Synthetic polypeptide
  source 1..1063: mol_type = other DNA
aagggcagccatctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcaggaatccaagcgctttgtgcagtggcagtcgtctatctga

SEQ ID NO: 7538 - DNA, 404 bp, synthetic construct
  misc_feature 1..404: note = Synthetic polypeptide
  source 1..404: mol_type = other DNA
aagggcagccatctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccc

SEQ ID NO: 7539 - DNA, 925 bp, synthetic construct
  misc_feature 1..925: note = Synthetic polypeptide
  source 1..925: mol_type = other DNA
aagggcagccatctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtga

SEQ ID NO: 7540 - DNA, 1093 bp, synthetic construct
  misc_feature 1..1093: note = Synthetic polypeptide
  source 1..1093: mol_type = other DNA
aagggcagccatctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccaggaatccaagcgctttgtgcagtggcagtcgtctatctgagcccctcctcccggctggactggagcctggctcccctcttcgttccttccctggctgccggaggagaccccactaa

SEQ ID NO: 7541 - DNA, 1133 bp, synthetic construct; identical to SEQ ID NO: 7332
  misc_feature 1..1133: note = Synthetic polypeptide
  source 1..1133: mol_type = other DNA

SEQ ID NO: 7542 - DNA, 1172 bp, synthetic construct; identical to SEQ ID NO: 7333
  misc_feature 1..1172: note = Synthetic polypeptide
  source 1..1172: mol_type = other DNA

SEQ ID NO: 7543 - DNA, 80 bp, synthetic construct; identical to SEQ ID NO: 6364
  misc_feature 1..80: note = Synthetic polypeptide
  source 1..80: mol_type = other DNA

SEQ ID NO: 7544 - DNA, 217 bp, synthetic construct; identical to SEQ ID NO: 6365
  misc_feature 1..217: note = Synthetic polypeptide
  source 1..217: mol_type = other DNA

SEQ ID NO: 7545 - DNA, 432 bp, synthetic construct
  misc_feature 1..432: note = Synthetic polypeptide
  source 1..432: mol_type = other DNA
aaaatagtgaccaagatctgcgcccagtgtgagatggagcacagtgctgacggcctcatggagcagatgtgctccagtgactttgtggtcaaaatgcgcatcaaggagatcaagatagagaatggggaccggaagctgattggagcccagaaaaagaagaagctgctcaagccgggccccctgaagcgcaaggacaccaagcggctggtgctgcacatgaagaatggcgcgggctgcccctgcccacagctggacagcctggcgggcagcttcctggtcatgggccgcaaagtggatggacagctgctgctcatggccgtctaccgctgggacaagaagaataaggagatgaagtttgcagtcaaattcatgttctcctacccctgctccctctactaccctttcttctacggggcggcagagccccactga

SEQ ID NO: 7546 - DNA, 784 bp, synthetic construct
  misc_feature 1..784: note = Synthetic polypeptide
  source 1..784: mol_type = other DNA
tgtagtaactggctttcaagatagcccccagtgaaccctacctcctgatgtttgcactgtgtataatcctctcacacaacataccaagttgatatgtgtgaacaatagaataaggtcagtgtgatagtatgtcacttttgaggttgcgttatgaccgacactgcagcttctgtctcagttgctctgtcagtttgtctctggaagccagctgccatgtggtgaacaggccagtggagaggccaacatagtgaggaactgaggctgttgtcatcagtcatgtgagtgagcctagaagcagattctccagcccagttaagccttcagatgactgaagccccaaccaacatcttgattaaaaactcatgagaagccccgaatcataatcacccacctaagctgcttctaaattcctgaccaacggaaactttgagataagaattgtgtcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccaggtag

SEQ ID NO: 7547 - DNA, 568 bp, synthetic construct; identical to SEQ ID NO: 6787
  misc_feature 1..568: note = Synthetic polypeptide
  source 1..568: mol_type = other DNA

SEQ ID NO: 7548 - DNA, 181 bp, synthetic construct; identical to SEQ ID NO: 6788
  misc_feature 1..181: note = Synthetic polypeptide
  source 1..181: mol_type = other DNA

SEQ ID NO: 7549 - DNA, 1643 bp, synthetic construct
  misc_feature 1..1643: note = Synthetic polypeptide
  source 1..1643: mol_type = other DNA
ggccgggtgcagtggctcactcctgtaattccagcactttgggaggctgaggcggctggatcacttgagatcaagagttcgagaccaccctgaccaacatgtggaatgagaccgtggagctttttcgtgctaagatgccgttacggaaacatcgctgtcgtttcaagagctatgagcattgtttcacagcggccgaagctgtggattggctgcatgagctgctgaggtgcagtcaaaacttcggccctgaagtgacccgcaaacaaacggtccagctgctaaaaaaattcctgaagaatcacgttattgaagacatcaagggaaaatggggtgaggaagattttgaagacaatcgtcacttatacagatttcctccttcttcacccctgaaaccatatccaaagaagcccccaaaccaaaaggatgttattaaatttccagaatggaatgatctcccaccaggcacttcacaagagaacatcccagtgaggccagttgtgatgaattctgagatgtggtacaagcgtcacagtattgcaattggagaggtgccagcttgccgtcttgtccaccgcagacagctgacagaggccaatgtagaagagatatggaagtctatgacattatcatacttacagaaaattcttggcctggattccttagaagaagttttagacgtcaaacttgtcaattcgaagttcatcatccataatgtatatagtgttagcaagcagggagttgttattcttgatgacaagtcaaaagaacttcctcattgggtgctgtcagctatgaagtgtttggcaaattggcccaactgttctgatttgaagcagcctatgtacttgggatttgaaaaagatgtctttaaaaccatagctgattactatggtcacttgaaagagcctctacttacatttcatctttttgatgcttttgtcagtgtactgggtttgttacagaaggagaaagtggcagttgaagcatttcagatttgctgccttctcctacctcctgaaaataggagaaagttacagctattgatgaggatgatggcaaggatttgcttaaacaaagagatgccacccctgtgtgatggctttggtacccgaacactgatggttcagacattttcccgttgcatcttgtgttccaaggatgaagtggacttggatgagttattagctgctagattggtaacgtttctgatggacaattaccaggaaattctgaaagtccctttggccttgcagacctctatagaggagcgtgtggctcatctacgaagagtccagataaaatacccaggagctgatatggatatcactttatctgctccatcattttgccgtcaaattagtccagaggaatttgaatatcaaagatcatatggctctcaggaacctctggcagccttgttggaggaagtcataacagatgccaaactctccaacaaagagaaaaagaagaaactgaagcagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaa

SEQ ID NO: 7550 - DNA, 1457 bp, synthetic construct
  misc_feature 1..1457: note = Synthetic polypeptide
  source 1..1457: mol_type = other DNA
ggccgggtgcagtggctcactcctgtaattccagcactttgggaggctgaggcggctggatcacttgagatcaagagttcgagaccaccctgaccaacatgtggaatgagaccgtggagctttttcgtgctaagatgccgttacggaaacatcgctgtcgtttcaagagctatgagcattgtttcacagcggccgaagctgtggattggctgcatgagctgctgaggtgcagtcaaaacttcggccctgaagtgacccgcaaacaaacggtccagctgctaaaaaaattcctgaagaatcacgttattgaagacatcaagggaaaatggggtgaggaagattttgaagacaatcgtcacttatacagatttcctccttcttcacccctgaaaccatatccaaagaagcccccaaaccaaaaggatgttattaaatttccagaatggaatgatctcccaccaggcacttcacaagagaacatcccagtgaggccagttgtgatgaattctgagatgtggtacaagcgtcacagtattgcaattggagaggtgccagcttgccgtcttgtccaccgcagacagctgacagaggccaatgtagaagagatatggaagtctatgacattatcatacttacagaaaattcttggcctggattccttagaagaagttttagacgtcaaacttgtcaattcgaagttcatcatccataatgtatatagtgttagcaagcagggagttgttattcttgatgacaagtcaaaagaacttcctcattgggtgctgtcagctatgaagtgtttggcaaattggcccaactgttctgatttgaagcagcctatgtacttgggatttgaaaaagatgtctttaaaaccatagctgattactatggtcacttgaaagagcctctacttacatttcatctttttgatgcttttgtcagtgtactgggtttgttacagaaggagaaagtggcagttgaagcatttcagatttgctgccttctcctacctcctgaaaataggagaaagttacagctattgatgaggatgatggcaaggatttgcttaaacaaagagatgccacccctgtgtgatggctttggtacccgaacactgatggttcagacattttcccgttgcatcttgtgttccaaggatgaagtggacttggatgagttattagctgctagattggtaacgtttctgatggacaattaccaggaaattctgaaagtccctttggccttgcagacctctatagaggagcgtgtggctcatctacgaagagtccagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaa

SEQ ID NO: 7551 - DNA, 637 bp, synthetic construct
  misc_feature 1..637: note = Synthetic polypeptide
  source 1..637: mol_type = other DNA
gctctagaggacacaactgggtttgaatgtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctga

SEQ ID NO: 7552 - DNA, 658 bp, synthetic construct
  misc_feature 1..658: note = Synthetic polypeptide
  source 1..658: mol_type = other DNA
gctctagaggacacaactgggtttgaatgtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggggaagtcgcggccactgcctgtgtga

SEQ ID NO: 7553 - DNA, 607 bp, synthetic construct
  misc_feature 1..607: note = Synthetic polypeptide
  source 1..607: mol_type = other DNA
gctctagaggacacaactgggtttgaatgtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatcc

SEQ ID NO: 7554 - DNA, 294 bp, synthetic construct
  misc_feature 1..294: note = Synthetic polypeptide
  source 1..294: mol_type = other DNA
cagccttactttaaaaaataaattctgaaactgactgcttctcaccaacttccctggcaccattgtggctaagccactgtcatattttcctgattatctcaccagacccctggagatctccacccagcagccagacggacgctatttaacaccaaggatacttttgtggaactctatgggaacaatgcagcagccgagagccgaaagggccaggaacgcttcaaccgctggttcctgacgggcatgactgtggccggcgtggttctgctgggctcactcttcagtcggaaatga

SEQ ID NO: 7555 - DNA, 208 bp, synthetic construct
  misc_feature 1..208: note = Synthetic polypeptide
  source 1..208: mol_type = other DNA
cagccttactttaaaaaataaattctgaaactgactgcttctcaccaacttccctggcaccattgtggctaagccactgtcatattttcctgattatctcaccagacccctggagatctccacccagcagccagacggacgctatttaacaccaaggatacttttgtggaactctatgggaacaatgcagcagccgagagccgaaagg

SEQ ID NO: 7556 - DNA, 1167 bp, synthetic construct
  misc_feature 1..1167: note = Synthetic polypeptide
  source 1..1167: mol_type = other DNA
agagacagggtgatatattggagacagcatgtgatttgtatccaaattctgcactagactcctagctcatcccattccagcagggtaaaaccagtaatccatagcaggatcaacgtgtcagctcgctttagaaaaccgcttcaggagccgtgcactatcttcttgattgcaaatggagacctcataaacccagcttctcgcctccttatccccagaaaaaccttgaatcagtgggatcatgtactacaaatggtcacagaaaaaatcactctgaggagcggggctgttcacaggctttatactttagaaggaaaacttgttgagagtggagcagagttggagaatgggcagttttatgtggctgttggcagagataagtttaagaaactgccttacagtgagttactttttgacaagtcaacgatgagaaggccttttggtcagaaagcttcttcactacctcctattgtaggatccagaaagtctaaagggagtggaaatgatcgccactctaagtcaacagttggatccagtgacaactcatctcctcagcccctgaagaggaaagggaaaaaagaagacgtgaattcagaaaaactgacgaaattgaaacaaaatgtaaaattaaagaattcacaagaaaccattccaaatagtgatgaaggcattttcaaagctggagcagagaggtctgaaacacggggggcagcagaagtccaagaagatgaagatactcaggttgaggttccagtcgatcagaggccagcagaaatagtagacgaggaagaagatggagagaaggcaaacaaggatgcagaacagaaagaagacttttcaggaatgaatggtgaccttgaagaggaaggaggtagggaggctacagatgcccctgagcaagtcgaggagattctggatcacagtgagcagcaggcacgccctgctcgtgtaaatggaggcaccgatgaggagaatggtgaggagctgcagcaggttaataatgagcttcaactggtcctagacaaggaaagaaagtctcaaggagctggcagtggacaagatgaggctgatgtagaccctcaaagaccaccaaggccagaagtaaaaattaccagtccagaagaaaatgaaaacaaccaacaaaacaaggactatgctgccgtggcttag

SEQ ID NO: 7557 - DNA, 1052 bp, synthetic construct; identical to SEQ ID NO: 447
  misc_feature 1..1052: note = Synthetic polypeptide
  source 1..1052: mol_type = other DNA

SEQ ID NO: 7558 - DNA, 1118 bp, synthetic construct; identical to SEQ ID NO: 448
  misc_feature 1..1118: note = Synthetic polypeptide
  source 1..1118: mol_type = other DNA

SEQ ID NO: 7559 - DNA, 2614 bp, synthetic construct
  misc_feature 1..2614: note = Synthetic polypeptide
  source 1..2614: mol_type = other DNA
ggtcaggcacagtggctcacacctgtaatcccagcactttactttgggaggctgacgtgggccaattgcttgagctcaggagttggagaccaggctgggcaacatatggagattctgtctctataaaaaataaaacattttagtcagtagccaggcatggtggtcctgcaatcaatcctagctactcgggaggctgaggcatgagaattgctcaaacgcgagaggcagaggttgcagtgagccaagatcgcaccactgcactccagcctggggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtggctgagcatcggagtggagttcgtggggaactgcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcctaa

SEQ ID NO: 7560 - DNA, 1747 bp, synthetic construct
  misc_feature 1..1747: note = Synthetic polypeptide
  source 1..1747: mol_type = other DNA
ggtcaggcacagtggctcacacctgtaatcccagcactttactttgggaggctgacgtgggccaattgcttgagctcaggagttggagaccaggctgggcaacatatggagattctgtctctataaaaaataaaacattttagtcagtagccaggcatggtggtcctgcaatcaatcctagctactcgggaggctgaggcatgagaattgctcaaacgcgagaggcagaggttgcagtgagccaagatcgcaccactgcactccagcctggggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtcagaagccgcctccctcgctccctgctcctccaggaattcccagcaggctctctggtgttcagggtccttgtccctcctttcccctaagcagaaaactggccctgccctgcccctgccccatttcctcctcatctga

SEQ ID NO: 7561 - DNA, 142 bp, synthetic construct
  misc_feature 1..142: note = Synthetic polypeptide
  source 1..142: mol_type = other DNA
gggcagctggggcacaagataagcctggacttggaggccagacccagagatgaccaagcgagacgtgcctggcttcgccatcgggggcctgagcgggggtgagagcaagtcgcagttctggcggatggtggcgctgagcacc

SEQ ID NO: 7562 - DNA, 613 bp, synthetic construct
  misc_feature 1..613: note = Synthetic polypeptide
  source 1..613: mol_type = other DNA
gggcagctggggcacaagataagcctggacttggaggccagacccagagatgaccaagcgagacgtgcctggcttcgccatcgggggcctgagcgggggtgagagcaagtcgcagttctggcggatggtggcgctgagcacctctcggctgccgaaggacaagccccgatatctgatgggggttggctatgccactgatctggtagtctgcgtggctcttggatgtgacatgttcgactgcgtcttccccacacggacagcgcgctttggctctgccctggtgcccactgggaacctgcagttgaggaagaaggtgtttgagaaggacttcggccccatagacccggagtgcacctgccccacgtgccaaaagcacagccgcgccttcctgcacgcactgctgcacagtgacaacacggccgcgctgcaccacctcacggtccacaacatcgcctaccagctgcagctcatgagcgccgtccgcaccagcatcgtggagaagcgcttcccggacttcgtgcgggacttcatgggcgccatgtacggggatcccaccctctgtcccacctgggccactgacgctctggcctctgtgggaatcacactgggctga

SEQ ID NO: 7563 - DNA, 204 bp, synthetic construct
  misc_feature 1..204: note = Synthetic polypeptide
  source 1..204: mol_type = other DNA
ccaggtgaaaggagccaggcacaaaaggataatgaagtccctgaggttaccagaagtcgcagtccaggccccccacaagtggatgggacacccaccatgtccctcgagagaccccccagggtgcctccgagagctgcctcacagaggcctccgaccagggagaccttccatcctcctccacctgttccacccagaggacgctga

SEQ ID NO: 7564 - DNA, 181 bp, synthetic construct
  misc_feature 1..181: note = Synthetic polypeptide
  source 1..181: mol_type = other DNA
ccaggataatgaagtccctgaggttaccagaagtcgcagtccaggccccccacaagtggatgggacacccaccatgtccctcgagagaccccccagggtgcctccgagagctgcctcacagaggcctccgaccagggagaccttccatcctcctccacctgttccacccagaggacgctga

SEQ ID NO: 7565 - DNA, 1661 bp, synthetic construct
  misc_feature 1..1661: note = Synthetic polypeptide
  source 1..1661: mol_type = other DNA
cggatcatgagtccatgaacatcctgacctccgtgctgctgctgtacaccaaggaggaggaagccttctggctgttggttgctgtgtgtgagcggatgctgcccgattacttcaaccaccgagtgatcggggcacaagttgaccagtctgtcttcgaggagctcatcaagggtcatctcccagagctggcagagcacatgaacgacctctcagccctggcgtccgtctctctctcgtggttcctgaccctgttcctcagcatcatgcctctagagagtgcggtgaatgtggtagactgcttcttctatgatggcatcaaagccatcttccagctgggactggctgtgcttgaggccaatgctgaggacctgtgcagcagcaaggatgatggccaggccttgatgatcctcagcaggtttctagatcacattaagaatgaggacagcccagggcccccagttggcagccaccatgcctttttctccgacgaccaggagccctaccctgtgactgatatttcggacctgatccgggattcctatgagaaatttggagaccagtctgtggagcagatcgagcacctacgttacaagcacaggatcagggtcctccaaggccacgaggacaccacaaagcagaacgtgcttcgagtcgttatcccggaagtctcaattcttcctgaagacctagaggagctctacgacttattcaagagagaacatatgatgagctgttactgggagcagcccaggcccatggcctcacgccacgaccccagccggccctatgctgagcagtaccgcatagatgcccggcagtttgcacacctgtttcagctagtctcgccctggacctgcggggcccacacggagatcctcgccgaaaggacgttcaggctcttggatgacaacatggaccagctcatcgagttcaaagcgtttgtgagctgcctcgatattatgtataatggagaaatgaatgagaagattaaactattatacaggcttcatatccctccagcactcactgaaaatgaccgagacagccagtcgccgttgaggaatcctctgttgtcaacatcgagacccctggttttcgggaaacccaatggtgatgcagttgattatcagaaacagctgaagcagatgattaaggatttagccaaagaaaaagataaaactgagaaagaattgcccaaaatgagccagagagaatttatccagttctgtaaaactctgtacagtatgttccatgaagatccagaagaaaatgatttgtatcaagccatcgccacagtcaccacactgctgctgcagatcggggaggtggggcagcgaggcagcagctctggaagctgctcccaggagtgtggggaggagctgcgggcttcagctccttctcctgaggactcggtttttgcagacactgggaagacgccccaggactcccaggcatttccagaggcggcagaaagggactggactgtctcccttgaacatattttagcttcacttctgactgaacagtcattagtcaacttttttgaaaagccactggacatgaaatccaaacttgaaaatgccaagatcaatcagtacaatctcaaaacttttgaaatgagccaccaatcacaatctgaacttaagctgagtaacttgtag

SEQ ID NO: 7566 - DNA, 1349 bp, synthetic construct; identical to SEQ ID NO: 7130
  misc_feature 1..1349: note = Synthetic polypeptide
  source 1..1349: mol_type = other DNA

SEQ ID NO: 7567 - DNA, 387 bp, synthetic construct; identical to SEQ ID NO: 544
  misc_feature 1..387: note = Synthetic polypeptide
  source 1..387: mol_type = other DNA

SEQ ID NO: 7568 - DNA, 540 bp, synthetic construct; identical to SEQ ID NO: 545
  misc_feature 1..540: note = Synthetic polypeptide
  source 1..540: mol_type = other DNA

SEQ ID NO: 7569 - DNA, 303 bp, synthetic construct; identical to SEQ ID NO: 547
  misc_feature 1..303: note = Synthetic polypeptide
  source 1..303: mol_type = other DNA

SEQ ID NO: 7570 - DNA, 871 bp, synthetic construct; identical to SEQ ID NO: 437
  misc_feature 1..871: note = Synthetic polypeptide
  source 1..871: mol_type = other DNA

SEQ ID NO: 7571 - DNA, 421 bp, synthetic construct; identical to SEQ ID NO: 441
  misc_feature 1..421: note = Synthetic polypeptide
  source 1..421: mol_type = other DNA

SEQ ID NO: 7572 - DNA, 638 bp, synthetic construct; identical to SEQ ID NO: 442
  misc_feature 1..638: note = Synthetic polypeptide
  source 1..638: mol_type = other DNA

SEQ ID NO: 7573 - DNA, 337 bp, synthetic construct; identical to SEQ ID NO: 443
  misc_feature 1..337: note = Synthetic polypeptide
  source 1..337: mol_type = other DNA

SEQ ID NO: 7574 - DNA, 1883 bp, synthetic construct; identical to SEQ ID NO: 6345
  misc_feature 1..1883: note = Synthetic polypeptide
  source 1..1883: mol_type = other DNA

SEQ ID NO: 7575 - DNA, 1031 bp, synthetic construct
  misc_feature 1..1031: note = Synthetic polypeptide
  source 1..1031: mol_type = other DNA
ggaagacctgctagagtagaaatgtcatttctccccaaacggatctatagattcattctggttccaatcaacgtccagttcagttgatttcctcccgagacttgagaagatgattctaaaatgtgtatggaagattcgagatctaagaatatctaggacacttctgaagaagacaggaagaagagacttggcctaccagatggcaagatgtgttgtaaaactgaagtcattacaataaggagctgattggggccctggtcctgtctgtgggcatctatgcagaggttgagcggcagaaatataaaacccttgaaagtgccttcctggctccagccatcatcctcatcctcctgggcgtcgtcatgttcatggtctccttcattggtgtgctggcgtccctccgtgacaacctgtaccttctccaagcattcatgtacatccttgggatctgcctcatcatggagctcattggtggcgtggtggccttgaccttccggaaccagaccattgacttcctgaacgacaacattcgaagaggaattgagaactactatgatgatctggacttcaaaaacatcatggactttgttcagaaaaagttcaagtgctgtggcggggaggactaccgagattggagcaagaatcagtaccacgactgcagtgcccctggacccctggcctgtggggtgccctacacctgctgcatcaggaacacgacagaagttgtcaacaccatgtgtggctacaaaactatcgacaaggagcgtttcagtgtgcaggatgtcatctacgtgcggggctgcaccaacgccgtgatcatctggttcatggacaactacaccatcatggcgggcatcctcctgggcatcctgcttccccagttcctgggggtgctgctgacgctgctgtacatcacccgggtggaggacatcatcatggagcactctgtcactgatgggctcctggggcccggtgccaagcccagcgtggaggcggcaggcacgggatgctgcttgtgctaccccaattag

SEQ ID NO: 7576 - DNA, 1033 bp, synthetic construct
  misc_feature 1..1033: note = Synthetic polypeptide
  source 1..1033: mol_type = other DNA
ccatcctgagttaagctaaactgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttga

SEQ ID NO: 7577 - DNA, 1048 bp, synthetic construct
  misc_feature 1..1048: note = Synthetic polypeptide
  source 1..1048: mol_type = other DNA
ccatcctgagttaagctaaactgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacaggtacttctgcagtggaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttga

SEQ ID NO: 7578 - DNA, 3525 bp, synthetic construct
  misc_feature 1..3525: note = Synthetic polypeptide
  source 1..3525: mol_type = other DNA
ttgtggacaatcttttcaaggatgtttgtagagcaagataggtataagatctcctctgacagcagcaagcaaagatactccctgtctgtctaaaagattcaggttccctaagcctagggttcttctgtgtgtgccagtgtccctggatcctcttcacatcaccttgtgagaatcttagctgaggaaccactacataaaaggaagatactctggctagcggtgtggctatgagttgtgaatagttctttgtctgtgacccaggaatcttctgccttctgccagcattgatgaaggtgtagctttcaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggtttggcaaacatcgaaaagatgacaagattgagaaaacgggtaaaataaaaatacaggaatcctttacatcagaagaggagaggatacgaatgaagcaggagcaggagaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctga

SEQ ID NO: 7579 - DNA, 3615 bp, synthetic construct
  misc_feature 1..3615: note = Synthetic polypeptide
  source 1..3615: mol_type = other DNA
ttgtggacaatcttttcaaggatgtttgtagagcaagataggtataagatctcctctgacagcagcaagcaaagatactccctgtctgtctaaaagattcaggttccctaagcctagggttcttctgtgtgtgccagtgtccctggatcctcttcacatcaccttgtgagaatcttagctgaggaaccactacataaaaggaagatactctggctagcggtgtggctatgagttgtgaatagttctttgtctgtgacccaggaatcttctgccttctgccagcattgatgaaggtgtagctttcaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggtttggcaaacatcgaaaagatgacaagattgagaaaacgggtaaaataaaaatacaggaatcctttacatcagaagaggagaggatacgaatgaagcaggagcaggagaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctga

SEQ ID NO: 7580 - DNA, 3552 bp, synthetic construct
  misc_feature 1..3552: note = Synthetic polypeptide
  source 1..3552: mol_type = other DNA
ttgtggacaatcttttcaaggatgtttgtagagcaagataggtataagatctcctctgacagcagcaagcaaagatactccctgtctgtctaaaagattcaggttccctaagcctagggttcttctgtgtgtgccagtgtccctggatcctcttcacatcaccttgtgagaatcttagctgaggaaccactacataaaaggaagatactctggctagcggtgtggctatgagttgtgaatagttctttgtctgtgacccaggaatcttctgccttctgccagcattgatgaaggtgtagctttcaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaatgcagagccaagccagatgcagattccaaaagaaacgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtgagtcaggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctga

SEQ ID NO: 7581 - DNA, 3654 bp, synthetic construct
  misc_feature 1..3654: note = Synthetic polypeptide
  source 1..3654: mol_type = other DNA
ttgtggacaatcttttcaaggatgtttgtagagcaagataggtataagatctcctctgacagcagcaagcaaagatactccctgtctgtctaaaagattcaggttccctaagcctagggttcttctgtgtgtgccagtgtccctggatcctcttcacatcaccttgtgagaatcttagctgaggaaccactacataaaaggaagatactctggctagcggtgtggctatgagttgtgaatagttctttgtctgtgacccaggaatcttctgccttctgccagcattgatgaaggtgtagctttcaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaatgcagagccaagccagatgcagattccaaaagaaacgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggtttggcaaacatcgaaaagatgacaagattgagaaaacgggtaaaataaaaatacaggaatcctttacatcagaagaggagaggatacgaatgaagcaggagcaggagaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctga

SEQ ID NO: 7582 - DNA, 3663 bp, synthetic construct
  misc_feature 1..3663: note = Synthetic polypeptide
  source 1..3663: mol_type = other DNA
ttgtggacaatcttttcaaggatgtttgtagagcaagataggtataagatctcctctgacagcagcaagcaaagatactccctgtctgtctaaaagattcaggttccctaagcctagggttcttctgtgtgtgccagtgtccctggatcctcttcacatcaccttgtgagaatcttagctgaggaaccactacataaaaggaagatactctggctagcggtgtggctatgagttgtgaatagttctttgtctgtgacccaggaatcttctgccttctgccagcattgatgaaggtgtagctttcaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaatgcagagccaagccagatgcagattccaaaagaaacgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtgagtcaggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggtttggcaaacatcgaaaagatgacaagattgagaaaacgggtaaaataaaaatacaggaatcctttacatcagaagaggagaggatacgaatgaagcaggagcaggagaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctga

SEQ ID NO: 7583 - DNA, 3459 bp, synthetic construct
  misc_feature 1..3459: note = Synthetic polypeptide
  source 1..3459: mol_type = other DNA
ttgtggacaatcttttcaaggatgtttgtagagcaagataggtataagatctcctctgacagcagcaagcaaagatactccctgtctgtctaaaagattcaggttccctaagcctagggttcttctgtgtgtgccagtgtccctggatcctcttcacatcaccttgtgagaatcttagctgaggaaccactacataaaaggaagatactctggctagcggtgtggctatgagttgtgaatagttctttgtctgtgacccaggaatcttctgccttctgccagcattgatgaaggtgtagctttcaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtagttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctga

SEQ ID NO: 7584 - DNA, 2559 bp, synthetic construct
  misc_feature 1..2559: note = Synthetic polypeptide
  source 1..2559: mol_type = other DNA
ttgtggacaatcttttcaaggatgtttgtagagcaagataggtataagatctcctctgacagcagcaagcaaagatactccctgtctgtctaaaagattcaggttccctaagcctagggttcttctgtgtgtgccagtgtccctggatcctcttcacatcaccttgtgagaatcttagctgaggaaccactacataaaaggaagatactctggctagcggtgtggctatgagttgtgaatagttctttgtctgtgacccaggaatcttctgccttctgccagcattgatgaaggtgtagctttcaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcagccttgccaaactgaagcccgagaagagatga

SEQ ID NO: 7585 - DNA, 2688 bp, synthetic construct
  misc_feature 1..2688: note = Synthetic polypeptide
  source 1..2688: mol_type = other DNA
ttgtggacaatcttttcaaggatgtttgtagagcaagataggtataagatctcctctgacagcagcaagcaaagatactccctgtctgtctaaaagattcaggttccctaagcctagggttcttctgtgtgtgccagtgtccctggatcctcttcacatcaccttgtgagaatcttagctgaggaaccactacataaaaggaagatactctggctagcggtgtggctatgagttgtgaatagttctttgtctgtgacccaggaatcttctgccttctgccagcattgatgaaggtgtagctttcaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaatgcagagccaagccagatgcagattccaaaagaaacgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcagccttgccaaactgaagcccgagaagagatga

SEQ ID NO: 7586 - DNA, 2598 bp, synthetic construct
  misc_feature 1..2598: note = Synthetic polypeptide
  source 1..2598: mol_type = other DNA
ttgtggacaatcttttcaaggatgtttgtagagcaagataggtataagatctcctctgacagcagcaagcaaagatactccctgtctgtctaaaagattcaggttccctaagcctagggttcttctgtgtgtgccagtgtccctggatcctcttcacatcaccttgtgagaatcttagctgaggaaccactacataaaaggaagatactctggctagcggtgtggctatgagttgtgaatagttctttgtctgtgacccaggaatcttctgccttctgccagcattgatgaaggtgtagctttcaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaatgcagagccaagccagatgcagattccaaaagaaacgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcagccttgccaaactgaagcccgagaagagatga

SEQ ID NO: 7587 - DNA, 1267 bp, synthetic construct; identical to SEQ ID NO: 463
  misc_feature 1..1267: note = Synthetic polypeptide
  source 1..1267: mol_type = other DNA

SEQ ID NO: 7588 - DNA, 285 bp, synthetic construct; identical to SEQ ID NO: 6477
  misc_feature 1..285: note = Synthetic polypeptide
  source 1..285: mol_type = other DNA

SEQ ID NO: 7589 - DNA, 238 bp, synthetic construct; identical to SEQ ID NO: 6378
  misc_feature 1..238: note = Synthetic polypeptide
  source 1..238: mol_type = other DNA

SEQ ID NO: 7590 - DNA, 299 bp, synthetic construct; identical to SEQ ID NO: 485
  misc_feature 1..299: note = Synthetic polypeptide
  source 1..299: mol_type = other DNA

SEQ ID NO: 7591 - DNA, 2471 bp, synthetic construct; identical to SEQ ID NO: 576
  misc_feature 1..2471: note = Synthetic polypeptide
  source 1..2471: mol_type = other DNA

SEQ ID NO: 7592 - DNA, 4259 bp, synthetic construct
  misc_feature 1..4259: note = Synthetic polypeptide
  source 1..4259: mol_type = other DNA
gcaaattggtaccagaagtggtatgctgctgaaaagatacccgaaaaagtagaagtgactttgaaactgggtaacaggcagaggttggaagagtttgaggggctcagaagaagacaggaaaatgtgggaaagtttggaactttctagagacttgttgaatggctttcaaccaaaatgctgtagctatatggacaataaagcccaggttgaggtggtctcagatggaaatgaggaagttgttgggaacttgagcaaaagtgactcttgctatattttagcaaaaagactggtggcattttgcccctgccctagagatttgtggaactttgaacttgagagagatgatttaggctatctggcagaagaaatttctaagcagcaaagcattcaagaggtgacttggatgctgttaaaagcattaagttttataagggaagtagagcataaaagtctggaaaatttgcagtctgacaatgcaatagaaaaggaaattccactttctggggaaaaattcaagctggctgcagaaatttgcataagtaacaagaagcctaatgttaatccccaagacaatgtggaaaatgtttccagggcaggtcagaggtcttcacagcagcctcttccatcacaggcctagaggcctaagaggaaaaaatggttttgtgggccaggcccagggtccccatgctgtgtgcagcctagggacttggtgctctgtgtcccagccactccagctgtggctgaaaggggctaatctagagcttaggccatggcttcagagggtgcaagccccaagccttggcagcttccacatagtgttgagcctgcaagtgcacagaagtcaagaattgatgtttgggaacctccctctagatttcagaagatgtgtggaaatgcccggatgcccaggcagaagtttgctgtaggtgtgttgtccttgtggagaacctctgcaagggcaataagacagggaaatgtgggatgggaggtgcctactgggtatccacctagtggagctgttgagaagagggccacagtcctccagaccctagaatggtagacccacctacagcttgcactgtgtgcctggaaaagccgcagacactcaacaccagcccatgaaagcagctgggagggtggctgtaccctgcaaagccacggggatggagctgcccaaggccatgggaacccacctcttgcataaacgttactcagatgcatgacatggagtcaaaggagatcattttggaactttaagatttgactgcattgctggattttggatttgcatggggcctgtagtgcctttgtttggctaatttctcccatttggaatggctatatttactcaatgcatatacctgcattgtatctaggaaataactaacttgcttttgattttacaggctcataggcaggcggtacttgccttgtcccagatgggactttggactgtggacttttgagttgatgcagaagatggactcagggtcccgaggcaagtcagactgttgcagaggctgaaaaccaaacctttgatgacagaattctcagtgaagtctaccatcatttcccgttatgccttcactacggtttcctgcagaatgctgaacagagcttctgaagaccaggacattgagttccagatgcagattccagctgcagctttcatcaccaacttcactatgcttattggagacaaggtgtatcagggcgaaattacagagagagaaaagaagagtggtgatagggtaaaagagaaaaggaataaaaccacagaagaaaatggagagaaggggactgaaatattcagagcttctgcagtgattcccagcaaggacaaagccgcctttttcctgagttatgaggagcttctgcagaggcgcctgggcaagtacgagcacagcatcagcgtgcggccccagcagctgtccgggaggctgagcgtggacgtgaatatcctggagagcgcgggcatcgcatccctggaggtgctgccgcttcacaacagcaggcagaggggcagtgggcgcggggaagatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccataccagccaagaattaaaatctctaaaacatcagtggatggtgatccccactttgttgtggatttccccctgagcagactcaccgtgtgcttcaacattgatgggcagcccggggacatcctcaggctggtctctgatcacagggactctggtgtcacagtgaacggagagttaattggggcacccgcccctccaaatggccacaagaaacagcgcacttacttgcgcactatcaccatcctcatcaacaagccagagagatcttatctcgagatcacaccgagcagagtcatcttggatggtggggacagactggtgctcccctgcaaccagagtgtggtggtggggagctgggggctggaggtgtccgtgtctgccaacgccaatgtcaccgtcaccatccagggctccatagcctttgtcatcctcatccacctctacaaaaagccggcgcccttccagcgacaccacctgggtttctacattgccaacagcgagggcctttccagcaactgccacggactgctgggtcagttcctgaatcaggatgccagactcacagaagaccctgcagggcccagccagaacctcactcaccctctgctccttcaggtgggagaggggcctgaggccgtcctaacagtgaaaggccaccaagtcccagtggtctggaagcaaaggaagatttacaacggggaagagcagatagactgctggtttgccaggaacaatgccgccaaactgattgacggggagtacaaggattacctggcattccatccatttgacacagggatggacacttggccggggaatgtccagggagctctgaagctggcagccttaaagatgcaagtgcatgaaggacagtga

SEQ ID NO: 7593 - DNA, 3476 bp, synthetic construct
  misc_feature 1..3476: note = Synthetic polypeptide
  source 1..3476: mol_type = other DNA
gcaaattggtaccagaagtggtatgctgctgaaaagatacccgaaaaagtagaagtgactttgaaactgggtaacaggcagaggttggaagagtttgaggggctcagaagaagacaggaaaatgtgggaaagtttggaactttctagagacttgttgaatggctttcaaccaaaatgctgtagctatatggacaataaagcccaggttgaggtggtctcagatggaaatgaggaagttgttgggaacttgagcaaaagtgactcttgctatattttagcaaaaagactggtggcattttgcccctgccctagagatttgtggaactttgaacttgagagagatgatttaggctatctggcagaagaaatttctaagcagcaaagcattcaagaggtgacttggatgctgttaaaagcattaagttttataagggaagtagagcataaaagtctggaaaatttgcagtctgacaatgcaatagaaaaggaaattccactttctggggaaaaattcaagctggctgcagaaatttgcataagtaacaagaagcctaatgttaatccccaagacaatgtggaaaatgtttccagggcaggtcagaggtcttcacagcagcctcttccatcacaggcctagaggcctaagaggaaaaaatggttttgtgggccaggcccagggtccccatgctgtgtgcagcctagggacttggtgctctgtgtcccagccactccagctgtggctgaaaggggctaatctagagcttaggccatggcttcagagggtgcaagccccaagccttggcagcttccacatagtgttgagcctgcaagtgcacagaagtcaagaattgatgtttgggaacctccctctagatttcagaagatgtgtggaaatgcccggatgcccaggcagaagtttgctgtaggtgtgttgtccttgtggagaacctctgcaagggcaataagacagggaaatgtgggatgggaggtgcctactgggtatccacctagtggagctgttgagaagagggccacagtcctccagaccctagaatggtagacccacctacagcttgcactgtgtgcctggaaaagccgcagacactcaacaccagcccatgaaagcagctgggagggtggctgtaccctgcaaagccacggggatggagctgcccaaggccatgggaacccacctcttgcataaacgttactcagatgcatgacatggagtcaaaggagatcattttggaactttaagatttgactgcattgctggattttggatttgcatggggcctgtagtgcctttgtttggctaatttctcccatttggaatggctatatttactcaatgcatatacctgcattgtatctaggaaataactaacttgcttttgattttacaggctcataggcaggcggtacttgccttgtcccagatgggactttggactgtggacttttgagttgatgcagaagatggactcagggtcccgaggcaagtcagactgttgcagaggctgaaaaccaaacctttgatgacagaattctcagtgaagtctaccatcatttcccgttatgccttcactacggtttcctgcagaatgctgaacagagcttctgaagaccaggacattgagttccagatgcagattccagctgcagctttcatcaccaacttcactatgcttattggagacaaggtgtatcagggcgaaattacagagagagaaaagaagagtggtgatagggtaaaagagaaaaggaataaaaccacagaagaaaatggagagaaggggactgaaatattcagagcttctgcagtgattcccagcaaggacaaagccgcctttttcctgagttatgaggagcttctgcagaggcgcctgggcaagtacgagcacagcatcagcgtgcggccccagcagctgtccgggaggctgagcgtggacgtgaatatcctggagagcgcgggcatcgcatccctggaggtgctgccgcttcacaacagcaggcagaggggcagtgggcgcggggaagatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccaccaaactccgtcaaaaaaaaacaaaacaaaacaaaaaaaagacatgggagagatggtgtttttcctctccaccacctggggatacgatga

SEQ ID NO: 7594 - DNA, 3497 bp, synthetic construct
  misc_feature 1..3497: note = Synthetic polypeptide
  source 1..3497: mol_type = other DNA
gcaaattggtaccagaagtggtatgctgctgaaaagatacccgaaaaagtagaagtgactttgaaactgggtaacaggcagaggttggaagagtttgaggggctcagaagaagacaggaaaatgtgggaaagtttggaactttctagagacttgttgaatggctttcaaccaaaatgctgtagctatatggacaataaagcccaggttgaggtggtctcagatggaaatgaggaagttgttgggaacttgagcaaaagtgactcttgctatattttagcaaaaagactggtggcattttgcccctgccctagagatttgtggaactttgaacttgagagagatgatttaggctatctggcagaagaaatttctaagcagcaaagcattcaagaggtgacttggatgctgttaaaagcattaagttttataagggaagtagagcataaaagtctggaaaatttgcagtctgacaatgcaatagaaaaggaaattccactttctggggaaaaattcaagctggctgcagaaatttgcataagtaacaagaagcctaatgttaatccccaagacaatgtggaaaatgtttccagggcaggtcagaggtcttcacagcagcctcttccatcacaggcctagaggcctaagaggaaaaaatggttttgtgggccaggcccagggtccccatgctgtgtgcagcctagggacttggtgctctgtgtcccagccactccagctgtggctgaaaggggctaatctagagcttaggccatggcttcagagggtgcaagccccaagccttggcagcttccacatagtgttgagcctgcaagtgcacagaagtcaagaattgatgtttgggaacctccctctagatttcagaagatgtgtggaaatgcccggatgcccaggcagaagtttgctgtaggtgtgttgtccttgtggagaacctctgcaagggcaataagacagggaaatgtgggatgggaggtgcctactgggtatccacctagtggagctgttgagaagagggccacagtcctccagaccctagaatggtagacccacctacagcttgcactgtgtgcctggaaaagccgcagacactcaacaccagcccatgaaagcagctgggagggtggctgtaccctgcaaagccacggggatggagctgcccaaggccatgggaacccacctcttgcataaacgttactcagatgcatgacatggagtcaaaggagatcattttggaactttaagatttgactgcattgctggattttggatttgcatggggcctgtagtgcctttgtttggctaatttctcccatttggaatggctatatttactcaatgcatatacctgcattgtatctaggaaataactaacttgcttttgattttacaggctcataggcaggcggtacttgccttgtcccagatgggactttggactgtggacttttgagttgatgcagaagatggactcagggtcccgaggcaagtcagactgttgcagaggctgaaaaccaaacctttgatgacagaattctcagtgaagtctaccatcatttcccgttatgccttcactacggtttcctgcagaatgctgaacagagcttctgaagaccaggacattgagttccagatgcagattccagctgcagctttcatcaccaacttcactatgcttattggagacaaggtgtatcagggcgaaattacagagagagaaaagaagagtggtgatagggtaaaagagaaaaggaataaaaccacagaagaaaatggagagaaggggactgaaatattcagagcttctgcagtgattcccagcaaggacaaagccgcctttttcctgagttatgaggagcttctgcagaggcgcctgggcaagtacgagcacagcatcagcgtgcggccccagcagctgtccgggaggctgagcgtggacgtgaatatcctggagagcgcgggcatcgcatccctggaggtgctgccgcttcacaacagcaggcagaggggcagtgggcgcggggaagatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccataccagccaagaattaaaatctctaaaacatcagttcgtggcttcagaagggaagaacagattttttcaaatgtcatgaaatttccttttgccagcatcctggaactataa

SEQ ID NO: 7595 - DNA, 3050 bp, synthetic construct
  misc_feature 1..3050: note = Synthetic polypeptide
  source 1..3050: mol_type = other DNA
tgatgtggcttggctgtgtccccacccacatctcatcttgaattcccacctgttgtgggaggaacccagtgggaggtaattgaatgatgggggcagatctttcctgtgctgtcctcatgatagtgagtaagtctcacactatctgatggttttaaaaagggaagtttcccttcacaagctcatttcttgcctgctgccatccatgtaagatgtgacttgctcctccttgtcttccaccatgattgtgaggcttccagctacatgaaactgatggactcagggtcccgaggcaagtcagactgttgcagaggctgaaaaccaaacctttgatgacagaattctcagtgaagtctaccatcatttcccgttatgccttcactacggtttcctgcagaatgctgaacagagcttctgaagaccaggacattgagttccagatgcagattccagctgcagctttcatcaccaacttcactatgcttattggagacaaggtgtatcagggcgaaattacagagagagaaaagaagagtggtgatagggtaaaagagaaaaggaataaaaccacagaagaaaatggagagaaggggactgaaatattcagagcttctgcagtgattcccagcaaggacaaagccgcctttttcctgagttatgaggagcttctgcagaggcgcctgggcaagtacgagcacagcatcagcgtgcggccccagcagctgtccgggaggctgagcgtggacgtgaatatcctggagagcgcgggcatcgcatccctggaggtgctgccgcttcacaacagcaggcagaggggcagtgggcgcggggaagatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccataccagccaagaattaaaatctctaaaacatcagtggatggtgatccccactttgttgtggatttccccctgagcagactcaccgtgtgcttcaacattgatgggcagcccggggacatcctcaggctggtctctgatcacagggactctggtgtcacagtgaacggagagttaattggggcacccgcccctccaaatggccacaagaaacagcgcacttacttgcgcactatcaccatcctcatcaacaagccagagagatcttatctcgagatcacaccgagcagagtcatcttggatggtggggacagactggtgctcccctgcaaccagagtgtggtggtggggagctgggggctggaggtgtccgtgtctgccaacgccaatgtcaccgtcaccatccagggctccatagcctttgtcatcctcatccacctctacaaaaagccggcgcccttccagcgacaccacctgggtttctacattgccaacagcgagggcctttccagcaactgccacggactgctgggtcagttcctgaatcaggatgccagactcacagaagaccctgcagggcccagccagaacctcactcaccctctgctccttcaggtgggagaggggcctgaggccgtcctaacagtgaaaggccaccaagtcccagtggtctggaagcaaaggaagatttacaacggggaagagcagatagactgctggtttgccaggaacaatgccgccaaactgattgacggggagtacaaggattacctggcattccatccatttgacacagggatggacacttggccggggaatgtccagggagctctgaagctggcagccttaaagatgcaagtgcatgaaggacagtga

SEQ ID NO: 7596 - DNA, 2267 bp, synthetic construct
  misc_feature 1..2267: note = Synthetic polypeptide
  source 1..2267: mol_type = other DNA
tgatgtggcttggctgtgtccccacccacatctcatcttgaattcccacctgttgtgggaggaacccagtgggaggtaattgaatgatgggggcagatctttcctgtgctgtcctcatgatagtgagtaagtctcacactatctgatggttttaaaaagggaagtttcccttcacaagctcatttcttgcctgctgccatccatgtaagatgtgacttgctcctccttgtcttccaccatgattgtgaggcttccagctacatgaaactgatggactcagggtcccgaggcaagtcagactgttgcagaggctgaaaaccaaacctttgatgacagaattctcagtgaagtctaccatcatttcccgttatgccttcactacggtttcctgcagaatgctgaacagagcttctgaagaccaggacattgagttccagatgcagattccagctgcagctttcatcaccaacttcactatgcttattggagacaaggtgtatcagggcgaaattacagagagagaaaagaagagtggtgatagggtaaaagagaaaaggaataaaaccacagaagaaaatggagagaaggggactgaaatattcagagcttctgcagtgattcccagcaaggacaaagccgcctttttcctgagttatgaggagcttctgcagaggcgcctgggcaagtacgagcacagcatcagcgtgcggccccagcagctgtccgggaggctgagcgtggacgtgaatatcctggagagcgcgggcatcgcatccctggaggtgctgccgcttcacaacagcaggcagaggggcagtgggcgcggggaagatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccaccaaactccgtcaaaaaaaaacaaaacaaaacaaaaaaaagacatgggagagatggtgtttttcctctccaccacctggggatacgatga

SEQ ID NO: 7597 - DNA, 2288 bp, synthetic construct
  misc_feature 1..2288: note = Synthetic polypeptide
  source 1..2288: mol_type = other DNA
tgatgtggcttggctgtgtccccacccacatctcatcttgaattcccacctgttgtgggaggaacccagtgggaggtaattgaatgatgggggcagatctttcctgtgctgtcctcatgatagtgagtaagtctcacactatctgatggttttaaaaagggaagtttcccttcacaagctcatttcttgcctgctgccatccatgtaagatgtgacttgctcctccttgtcttccaccatgattgtgaggcttccagctacatgaaactgatggactcagggtcccgaggcaagtcagactgttgcagaggctgaaaaccaaacctttgatgacagaattctcagtgaagtctaccatcatttcccgttatgccttcactacggtttcctgcagaatgctgaacagagcttctgaagaccaggacattgagttccagatgcagattccagctgcagctttcatcaccaacttcactatgcttattggagacaaggtgtatcagggcgaaattacagagagagaaaagaagagtggtgatagggtaaaagagaaaaggaataaaaccacagaagaaaatggagagaaggggactgaaatattcagagcttctgcagtgattcccagcaaggacaaagccgcctttttcctgagttatgaggagcttctgcagaggcgcctgggcaagtacgagcacagcatcagcgtgcggccccagcagctgtccgggaggctgagcgtggacgtgaatatcctggagagcgcgggcatcgcatccctggaggtgctgccgcttcacaacagcaggcagaggggcagtgggcgcggggaagatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccataccagccaagaattaaaatctctaaaacatcagttcgtggcttcagaagggaagaacagattttttcaaatgtcatgaaatttccttttgccagcatcctggaactataa

SEQ ID NO: 7598 - DNA, 116 bp, synthetic construct
  misc_feature 1..116: note = Synthetic polypeptide
  source 1..116: mol_type = other DNA
cagagaccaagttcattctgtcaactgatctccagcacctggcccagagacggaaagtacaaagactagtaaaatacatccttgcccttaaggagctaagtacccaaaacctgtaa

SEQ ID NO: 7599 - DNA, 1025 bp, synthetic construct
  misc_feature 1..1025: note = Synthetic polypeptide
  source 1..1025: mol_type = other DNA
ggccaggcacagtggcccacgcctgtaatcccagcactttgggaggccaaggcaggtggatcacctgaggtcagccgttcgagaccagcctggccaacgtggtgaaaccctgtctctactaaaaatacaaaaattagccggggtggtggcaggtgcctgtaatcccagctgctcaggaggctgagctgctaaaaggagtgaccatcgccagtggaggcgtcctgcccagaattcaccccgaactgctggccaaaaagcgagggaccaaaggcaagtcggaaacgatcctctccccacccccagagaaaagaggcaggaaggccacgtcaggcaagaagggggggaagaaatccaaggctgccaaaccacggacgtccaaaaagtccaaaccaaaggacagcgataaagaaggaacttcaaattccacctctgaagatgggccaggggatggattcaccattctgtcttctaagagccttgttctgggacagaagctgtccttaacccagagtgacatcagccatattggctccatgagagtggagggcattgtccacccaaccacagccgaaattgacctcaaagaagatataggtaaagccttggaaaaggctgggggaaaagagttcttggaaacggtaaaggagcttcgcaaatcccaaggccctttggaagtcgccgaagccgccgtcagccaatccagtggactcgcagccaaatttgtcatccactgtcacatccctcagtggggctccgacaaatgtgaagaacagcttgaagagaccatcaaaaactgcctgtcagcggcggaggacaagaagctaaagtccgtcgcgttcccgcctttccccagcggcagaaactgctttcccaaacagactgcggcccaggtgaccctcaaagccatctcagcccactttgatgactcgagcgcgtcctcgctgaagaacgtgtacttcctgctcttcgacagcgagagcatcggcatctacgtgcaggagatggccaagctcgacgccaagtag

SEQ ID NO: 7600 - DNA, 200 bp, synthetic construct
  misc_feature 1..200: note = Synthetic polypeptide
  source 1..200: mol_type = other DNA
ccacaaacaaaaatgaacaaaatagggaaataggctatattgttaagtgaaaaagcagaacacagaatactactgttctatcacattgggtatctagatacatagaaaaaagactggaaggacattcacacatcaaaacgggtgacacatctggagactacaggaaagtactgcttgttctctgtggaggagatgattaa

SEQ ID NO: 7601 - DNA, 274 bp, synthetic construct
  misc_feature 1..274: note = Synthetic polypeptide
  source 1..274: mol_type = other DNA
tttatctctcaggcttcatctgtgaaatgaatgggagtaacagcaacatccacctcacaggttcagggattatctcaatgatgaggccttatggaacaagtgccgagagcctctcaatgtggttccctggaatctgaccctcttctccatcctgctggtcgtaggaggaatccagatggttctctgcgccatccaggtggtcaatggcctcctggggaccctctgtggggactgccagtgttgtggctgctgtgggggagatggacccgtttaa

SEQ ID NO: 7602 - DNA, 158 bp, synthetic construct
  misc_feature 1..158: note = Synthetic polypeptide
  source 1..158: mol_type = other DNA
gtggtggctcatgcctgtaatttcagcactttgggaggccaaggcaggcggatcacttgaggttctgtttggattctgcaaagcagactcgtcagaaagttgctgtgaactggaccaacttcagcctcaagaaaaccactcctagcacagctcagtga

SEQ ID NO: 7603 - DNA, 520 bp, synthetic construct
  misc_feature 1..520: note = Synthetic polypeptide
  source 1..520: mol_type = other DNA
ccccccacttcccttctcccctttcttatccctcaagcctcagccaaaagcctgcttctttagggcagtctttcctgaccatcctatctaaggtgtccttacttgttattcttagatctctgtaccttgtctgattttttcacagctcttggatttggtgattctttgtgaattgttacacctgatggtctttctccaccactagatgaacgtgtactacacgagcagtcagcagatccatgtgggcattctgagccccaccgtggatgatgatgacaaccgatgcctggtggacgtcaacagccggccccggctcatcgaatgcagctacgccaaagccaagaggatgaagcttcactggcagttctctcagggaggacccatccagaaccgcaagtctaagcgctgtctggagctgcaggagaatagcgacctggagttcggcttccagctggtgttgcagaagtgctcgggccagcactggagcatcaccaacgtcctgaggagcctcgcgtcctga

SEQ ID NO: 7604 - DNA, 330 bp, synthetic construct
  misc_feature 1..330: note = Synthetic polypeptide
  source 1..330: mol_type = other DNA
ggccgggcgcggttgctcacgcctgtaatcccaacactttgggaggctaagccagatggatcacctgaggccaaatttgagtttcatcatggtgactatgaaaaacagtttctgcatgtactgagccgcaaggacaagactggaatcgttgtcaacaatcctaaccagtcagtgtttctcttcattgacagacagcacttgcagactccaaaaaacaaagctacaatcttcaagttatgcagcatctgcctctacctgccacaggaacagctcacccactgggcagttggcaccatagaggatcacctccgtccttatatgccagagtag

SEQ ID NO: 7605 - DNA, 1384 bp, synthetic construct
  misc_feature 1..1384: note = Synthetic polypeptide
  source 1..1384: mol_type = other DNA
ggcgaggcacggtggctcacgcctgtaatcccagcactttggaaggccaaggcgggcagatcacgagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtga

SEQ ID NO: 7606 - DNA, 1683 bp, synthetic construct
  misc_feature 1..1683: note = Synthetic polypeptide
  source 1..1683: mol_type = other DNA
tgccacagaagtttcactgggaaggctgaagctcttcttcagcaaaatggcgacttcctggttcgcgcctctgggtcccgtgggggcaaccccgtgatctcctgccgctggcggggctcagccctccattttgaggtgttccgtgtggccctgcgtccccggccaggccgacccacagccctctttcaactggaggatgagcaattccccagcataccggctctggttcacagttatatgacaggcaggcgcccactgtcccaggccacaggggctgtggtctccaggcctgtgacttggcaggggcctctgcgacgcagctttagcgaggacaccctgatggatggcccagctcggatagagcctctcagggcaaggaagtggagcaacagtcagcctgcagatttggcacatatggggcggtcaagagaagaccccgctgggatggaagcctccaccatgcccatatctgccttgccccgaacgagcagtgacccggtgttgctgaaggcccctgctcccctgggaactgttgccgacagtctcagggcctccgatgggcagcttcaagccaaggcaccaacgaagcccccccggacaccctccttcgaactgcctgatgcctctgaacgtcccccgacgtactgcgagctggtgccccgagtgcccagtgtccagggaacatccccgagccaaagctgcccagagccagaggccccatggtgggaggccgaggaggatgaggaggaagagaatagatgttttacaagaccacaggctgagatctctttctgcccccatgatgccccctcctgcctgctgggcccccagaatcggcccctggaaccccaagtcctgcataccctccgtggcctgttcctggagcaccatcctgggagcaccgcccttcacctgctattggtagactgccaggccacaggcctcctgggagtgaccagagatcagcggggcaacatgggagtctcatctggcctggagctgctcactcttccccatggacaccacttgaggttggaactgctggagaggcatcagacactggcgctggccggggcgctggcggtgctgggctgctcggggccgctggaggagcgcgcagccgcactgaggggactggtagagctggcgctggcgctgcggccaggggcggcgggggacctgcccgggctggctgcagtcatgggcgccctgctcatgccccaggtgtcccggttggagcacacgtggcgccagctccgaaggagccacacggaggctgcgctggcctttgagcaggagctgaagccgctgatgcgggctctggatgagggcgctggaccctgcgaccccggcgaggtggcgctgccgcacgtggcacccatggttcgcctactggagggcgaggaagtcgcggggccgctggacgagagctgtgagcggctgttgcgcaccctgcacggggcgcgtcacatggtccgggacgcacccaaattccgcaaggtggcagcccagcgcctgcgaggattccggcctaacccggagctgagggaggccctgaccaccggcttcgtgcggaggctgctctggggtagccggggcgcgggagctccgcgcgctgaacgctttgagaagttccagcgcgtcctcggcgtcctgtcgcagcgcctggagcctgaccgctga

SEQ ID NO: 7607 - DNA, 666 bp, synthetic construct
  misc_feature 1..666: note = Synthetic polypeptide
  source 1..666: mol_type = other DNA
tgccacagaagtttcactgggaaggctgaagctcttcttcagcaaaatggcgacttcctggttcgcgcctctgggtcccgtgggggcaaccccgtgatctcctgccgctggcggggctcagccctccattttgaggtgttccgtgtggccctgcgtccccggccaggccgacccacagccctctttcaactggaggatgagcaattccccagcataccggctctggttcacagttatatgacaggcaggcgcccactgtcccaggccacaggggctgtggtctccaggcctgtgacttggcaggggcctctgcgacgcagctttagcgaggacaccctgatggatggcccagctcggatagagcctctcagggcaaggaagtggagcaacagtcagcctgcagatttggcacatatggggcggtcaagagaagaccccgctgggatggaatcggcccctggaaccccaagtcctgcataccctccgtggcctgttcctggagcaccatcctgggagcaccgcccttcacctgctattggtagactgccaggccacaggcctcctgggagtgaccagagatcagcggggcaacatgggagtctcatctggcctggagctgctcactcttccccatggacaccacttgaggttggaactgctggagag

SEQ ID NO: 7608 - DNA, 2309 bp, synthetic construct
  misc_feature 1..2309: note = Synthetic polypeptide
  source 1..2309: mol_type = other DNA
gccgggtgcagtggctcaagcctgtaatctcagcactttgggaggctgaggcggatggatcacaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgaggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcagccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctga

SEQ ID NO: 7609 - DNA, 2389 bp, synthetic construct
  misc_feature 1..2389: note = Synthetic polypeptide
  source 1..2389: mol_type = other DNA
gccgggtgcagtggctcaagcctgtaatctcagcactttgggaggctgaggcggatggatcacaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtggtgctgtaaggggtgactggagggagaagcctggctgctggtcacaccgcttcccttgtcctggccggcatgctctggtgggcgggacgatcattggcagtgcgcggtgccaggccttccgcacgcgggaaggccgcctgaaggctgcttgcaacctgctgcagcgaggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcagccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctga

SEQ ID NO: 7610 - DNA, 771 bp, synthetic construct
  misc_feature 1..771: note = Synthetic polypeptide
  source 1..771: mol_type = other DNA
gcctggctcggcggctcacgcctgtaaccgcagcactgggaggccaaggcgggaggatccctttagcccacgagttcgagacaagcctgggcaacacctcaaaaccccatctctacaaaaaacataaaaattatctggatgtggtggtgtgtgcctgtggtcccagctactctggaggctgaggtgctggaggacggccggcagtggtggaagctgcgcagccgcagcggccaggcggggtacgtgccctgcaacatcctaggcgaggcgcgaccggaggacgccggcgccccgttcgagcaggccggtcagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctag

SEQ ID NO: 7611 - DNA, 5853 bp, synthetic construct
  misc_feature 1..5853: note = Synthetic polypeptide
  source 1..5853: mol_type = other DNA
acagaagggtgcagtggtagtgtgaactccagacttggaacacctgggttcagatcttagctctaccacttaccagctgtgtcatatgggacaaatcccttaacctctctgggcctctagaaacagatacagttatagcactcacctcatatgcttaacagagttaaaaaatgttaaactctctgaacagtgcctggcacatactaagcgctacataaaggcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtgaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccagtggcggccagaggagtccgaggactatgaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtgcccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggtgatttctggaggatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctacgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaa

SEQ ID NO: 7612 - DNA, 5826 bp, synthetic construct
  misc_feature 1..5826: note = Synthetic polypeptide
  source 1..5826: mol_type = other DNA
acagaagggtgcagtggtagtgtgaactccagacttggaacacctgggttcagatcttagctctaccacttaccagctgtgtcatatgggacaaatcccttaacctctctgggcctctagaaacagatacagttatagcactcacctcatatgcttaacagagttaaaaaatgttaaactctctgaacagtgcctggcacatactaagcgctacataaaggcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtgaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtgcccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggtgatttctggaggatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctacgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaa

SEQ ID NO: 7613 - DNA, 917 bp, synthetic construct
  misc_feature 1..917: note = Synthetic polypeptide
  source 1..917: mol_type = other DNA
acagaagggtgcagtggtagtgtgaactccagacttggaacacctgggttcagatcttagctctaccacttaccagctgtgtcatatgggacaaatcccttaacctctctgggcctctagaaacagatacagttatagcactcacctcatatgcttaacagagttaaaaaatgttaaactctctgaacagtgcctggcacatactaagcgctacataaaggcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgaggtcttgccgcatgggcccggagccccatgggaatttggagccatccaatccgacttcttggtgtatgtgcatgtgtgtgtgcacacacgggcacacttatctgtgtgta

SEQ ID NO: 7614 - DNA, 1423 bp, synthetic construct; identical to SEQ ID NO: 6512
  misc_feature 1..1423: note = Synthetic polypeptide
  source 1..1423: mol_type = other DNA

SEQ ID NO: 7615 - DNA, 1631 bp, synthetic construct
  misc_feature 1..1631: note = Synthetic polypeptide
  source 1..1631: mol_type = other DNA
gccaggtgcggtgactcacgcctgtaatcccagcactttggaaggccaaggcgggtggatagcaaggtcaagagatcgagaccagcctggccaacatgctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagctgcgcagccgcggggacaacgtgtacgtggtgactgaggtgctgcagacacagaaggaggtggaagtcacgcgcacccacaagcgggagggctcgggccggttttccctgcccggagccacgtgcttgcagggtgagggccagggccatctgagccagaagaagacggtcaccatcccctcaggcagcaccctcgcattccgggtggcccagctggttattgactctgacttggacgtccttctcttcccggataagaagcagaggaccttccagccacccgcgacaggccacaagcgttccacgagcgaaggcgcctggccacagctgccctctggcctctccatgatgaggtgcctccacaacttcctgacagatggggtccctgcggagggggcgttcactgaagacttccagggcctacgggcagaggtggagaccatctccaaggaactggagcttttggacagagagctgtgccagctgctgctggagggcctggagggggtgctgcgggaccagctggccctgcgagccttggaggaggcgctggagcagggccagagccttgggccggtggagcccctggacggtccagcaggtgctgtcctggagtgcctggtgttgtcctccggaatgctggtgccggaactcgctatccctgttgtctacctgctgggggcactgaccatgctgagtgaaacgcagcacaagctgctggcggaggcgctggagtcgcagaccctgttggggccgctcgagctggtgggcagcctcttggagcagagtgccccgtggcaggagcgcagcaccatgtccctgccccccgggctcctggggaacagctggggcgaaggagcaccggcctgggtcttgctggacgagtgtggcctagagctgggggaggacactccccacgtgtgctgggagccgcaggcccagggccgcatgtgtgcactctacgcctccctggcactgctatcaggactgagccaggagccccactag

SEQ ID NO: 7616 - DNA, 346 bp, synthetic construct
  misc_feature 1..346: note = Synthetic polypeptide
  source 1..346: mol_type = other DNA
gaaccataggaaacagctgatatccaaccatttttgaacctacacaggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactga

SEQ ID NO: 7617 - DNA, 123 bp, synthetic construct
  misc_feature 1..123: note = Synthetic polypeptide
  source 1..123: mol_type = other DNA
ggtacagtggctcacacctgtcatcccagcactttgccaagacagccctgcacctccgggctcggcggaacttccgggacttcaggggagtgtcccgccgcactggggaggagtggctggtaa

SEQ ID NO: 7618 - DNA, 2051 bp, synthetic construct
  misc_feature 1..2051: note = Synthetic polypeptide
  source 1..2051: mol_type = other DNA
ggtacagtggctcacacctgtcatcccagcactttgccaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaa

SEQ ID NO: 7619 - DNA, 406 bp, synthetic construct
  misc_feature 1..406: note = Synthetic polypeptide
  source 1..406: mol_type = other DNA
ggtacagtggctcacacctgtcatcccagcactttgccaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatga

SEQ ID NO: 7620 - DNA, 458 bp, synthetic construct
  misc_feature 1..458: note = Synthetic polypeptide
  source 1..458: mol_type = other DNA
actacatttcccaagcttctttgcactttgatttccacccaggtcaaccaatgggaggtactgtcaggagaatgatggcggggaggaaggatgaagccagagtactatttcctctttctttaccacggcagaggctctggctgtgactatgtctcctcatggccactaatgtgtccgccaccttgaccttcaataccagcaagatcactgggttcctgaagccaggaaaggtaaaagtggaactgaaagaatccaaagttggactattcaatgcagagctgttggaagcgctcctcaactattacatccttaacaccttctaccccaagttcaatgataagttggccgaaggcttcccccttcctctgctgaagcgtgttcagctctacgaccttgggctgcagatccataaggacttcctgttcttgggtgccaatgtccaatacatgagagtttga

SEQ ID NO: 7621 - DNA, 282 bp, synthetic construct
  misc_feature 1..282: note = Synthetic polypeptide
  source 1..282: mol_type = other DNA
ggccgggtgcggtggctcacacctgtaatcctagcatcttgggaggctgaggcaggaggatcgcttgagcccaggagtttgagaccagcctaggcaacataaggagaccccatctctacaaaatatcaaaaaattacccaggtatggtggcacacacgtgtgattccagctactcgggaggctgagatgggaggatcacttgaacccaggaggttggggctacaatgagctatgatcgcaccacttcattccagcctggatgacagaagactcactccatag

SEQ ID NO: 7622 - DNA, 1227 bp, synthetic construct
  misc_feature 1..1227: note = Synthetic polypeptide
  source 1..1227: mol_type = other DNA
ccgaggatcagagatgtcctagtcccagctcatccaccaacttgccatatgactttgggcaagttacctcaccttcagatgcctccattggaaaagaatacaaggaaactcagccaagaatgtttaaagcagctggcaatcaagaagcagcagcacattgacaacataacccagatagaagatgccaccgagaagctcaaggctaatgcagagtcaagtaaaacctggctgaaggggaaattcactgaactcagattactacttgacgaagaggaagcgctggccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaagcataaactgccagctctcagacccttccagcaccaagccaggtaccttgttgaaaaccagcccctcaccagagcgatcgctattgctgaaatacgcgcgcacgcccacgctggatcctgacacgatgcacgcgcgcctgcgcctgtccgccgatcgcctgacggtgcgctgcggcctgctgggcagcctggggcccgtgcccgtgctgcggttcgacgcgctctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagccgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctag

SEQ ID NO: 7623 - DNA, 536 bp, synthetic construct
  misc_feature 1..536: note = Synthetic polypeptide
  source 1..536: mol_type = other DNA
ggtcaggcatggtggcgcatgtctgtaatcccagcactttgggaggccaatgcaggcgggttacttgagacgaggagtttgagaccagcctgggcaacacagtgagacccccatctctataaaaaaaaaaaaaaaccaattagctgggctcagtgacatgtacctatagtcccagctacttgggaaactgacatggaaagattgcttgagcccaggagtttgaggctgcactttatcttcaagccaggatgaagggagactgggcaagactcttacgccccacactgcaatttggtcttgttgccgtatccatttatgtgggcctttctcgagtttctgattataaacaccactggagcgatgtgttgactggactcattcagggagctctggttgcaatattagttgctgtatatgtatcggatttcttcaaagaaagaacttcttttaaagaaagaaaagaggaggactctcatacaactctgcatgaaacaccaacaactgggaatcactatccgagcaatcaccagccttga

SEQ ID NO: 7624 - DNA, 889 bp, synthetic construct
  misc_feature 1..889: note = Synthetic polypeptide
  source 1..889: mol_type = other DNA
ggccggtgtggtggctcacgcctgaaatcccagcactttgggaggctgagtggatggtgatccccactttgttgtggatttccccctgagcagactcaccgtgtgcttcaacattgatgggcagcccggggacatcctcaggctggtctctgatcacagggactctggtgtcacagtgaacggagagttaattggggcacccgcccctccaaatggccacaagaaacagcgcacttacttgcgcactatcaccatcctcatcaacaagccagagagatcttatctcgagatcacaccgagcagagtcatcttggatggtggggacagactggtgctcccctgcaaccagagtgtggtggtggggagctgggggctggaggtgtccgtgtctgccaacgccaatgtcaccgtcaccatccagggctccatagcctttgtcatcctcatccacctctacaaaaagccggcgcccttccagcgacaccacctgggtttctacattgccaacagcgagggcctttccagcaactgccacggactgctgggtcagttcctgaatcaggatgccagactcacagaagaccctgcagggcccagccagaacctcactcaccctctgctccttcaggtgggagaggggcctgaggccgtcctaacagtgaaaggccaccaagtcccagtggtctggaagcaaaggaagatttacaacggggaagagcagatagactgctggtttgccaggaacaatgccgccaaactgattgacggggagtacaaggattacctggcattccatccatttgacacagggatggacacttggccggggaatgtccagggagctctgaagctggcagccttaaagatgcaagtgcatgaaggacagtga

SEQ ID NO: 7625 - DNA, 844 bp, synthetic construct
  misc_feature 1..844: note = Synthetic polypeptide
  source 1..844: mol_type = other DNA
ggccggtgtggtggctcacgcctgaaatcccagcactttgggaggctgagtggatggtgatccccactttgttgtggatttccccctgagcagactcaccgtgtgcttcaacattgatgggcagcccggggacatcctcaggctggtctctgatcacagggactctggtgtcacagtgaacggagagttaattggggcacccgcccctccaaatggccacaagaaacagcgcacttacttgcgcactatcaccatcctcatcaacaagccagagagatcttatctcgagatcacaccgagcagagtcatcttggatggtggggacagactggtgctcccctgcaaccagagtgtggtggtggggagctgggggctggaggtgtccgtgtctgccaacgccaatgtcaccgtcaccatccagggctccatagcctttgtcatcctcatccacctctacaaaaagccggcgcccttccagcgacaccacctgggtttctacattgccaacagcgagggcctttccagcaactgccacggactgctgggtcagttcctgaatcaggatgccagactcacagaagaccctgcagggcccagccagaacctcactcaccctctgctccttcaggtgggagaggggcctgaggccgtcctaacagtgaaaggccaccaagtcccagtggtctggaagcaaaggaagatttacaacggggaagagcagatagactgctggtttgccaggaacaatgccgccaaactgattgacggggagtacaaggattacctggcattccatccatttgacacagggatgcttggccggggaatgtccagggagctctga

SEQ ID NO: 7626 - DNA, 742 bp, synthetic construct; identical to SEQ ID NO: 6357
  misc_feature 1..742: note = Synthetic polypeptide
  source 1..742: mol_type = other DNA

SEQ ID NO: 7627 - DNA, 590 bp, synthetic construct; identical to SEQ ID NO: 6358
  misc_feature 1..590: note = Synthetic polypeptide
  source 1..590: mol_type = other DNA

SEQ ID NO: 7628 - DNA, 577 bp, synthetic construct; identical to SEQ ID NO: 6359
  misc_feature 1..577: note = Synthetic polypeptide
  source 1..577: mol_type = other DNA

SEQ ID NO: 7629 - DNA, 430 bp, synthetic construct; identical to SEQ ID NO: 6360
  misc_feature 1..430: note = Synthetic polypeptide
  source 1..430: mol_type = other DNA

SEQ ID NO: 7630 - DNA, 670 bp, synthetic construct; identical to SEQ ID NO: 6361
  misc_feature 1..670: note = Synthetic polypeptide
  source 1..670: mol_type = other DNA

SEQ ID NO: 7631 - DNA, 2284 bp, synthetic construct
  misc_feature 1..2284: note = Synthetic polypeptide
  source 1..2284: mol_type = other DNA
gtggccaaccacatgggcctggagctgggttcaaaccctgactttggcactacttattagctgtgtgaccttgggacagttaattaccactctgcaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggcttagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggggaagtcgcggccactgcctgtgtga

SEQ ID NO: 7632 - DNA, 2263 bp, synthetic construct
  misc_feature 1..2263: note = Synthetic polypeptide
  source 1..2263: mol_type = other DNA
gtggccaaccacatgggcctggagctgggttcaaaccctgactttggcactacttattagctgtgtgaccttgggacagttaattaccactctgcaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggcttagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctga

SEQ ID NO: 7633 - DNA, 459 bp, synthetic construct
  misc_feature 1..459: note = Synthetic polypeptide
  source 1..459: mol_type = other DNA
gtggccaaccacatgggcctggagctgggttcaaaccctgactttggcactacttattagctgtgtgaccttgggacagttaattaccactctgcaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaa

SEQ ID NO: 7634 - DNA, 400 bp, synthetic construct
  misc_feature 1..400: note = Synthetic polypeptide
  source 1..400: mol_type = other DNA
gtggccaaccacatgggcctggagctgggttcaaaccctgactttggcactacttattagctgtgtgaccttgggacagttaattaccactctgcaggtagaacacctgaaggagaagctcattagccaggcccaggaagtgagccgactgcgatctgagctgcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggct

SEQ ID NO: 7635 - DNA, 270 bp, synthetic construct
  misc_feature 1..270: note = Synthetic polypeptide
  source 1..270: mol_type = other DNA
gtggccaaccacatgggcctggagctgggttcaaaccctgactttggcactacttattagctgtgtgaccttgggacagttaattaccactctgcaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaa

SEQ ID NO: 7636 - DNA, 220 bp, synthetic construct
  misc_feature 1..220: note = Synthetic polypeptide
  source 1..220: mol_type = other DNA
gtggccaaccacatgggcctggagctgggttcaaaccctgactttggcactacttattagctgtgtgaccttgggacagttaattaccactctgcaggtagaacacctgaaggagaagctcattagccaggcccaggaagtgagccgactgcgatctgagctggggggcaccgacttggagaagcaccgggacctgctgatggtggagaatgagcgactg

SEQ ID NO: 7637 - DNA, 179 bp, synthetic construct
  misc_feature 1..179: note = Synthetic polypeptide
  source 1..179: mol_type = other DNA
gtggccaaccacatgggcctggagctgggttcaaaccctgactttggcactacttattagctgtgtgaccttgggacagttaattaccactctgcaggtagaacacctgaaggagaagctcattagccaggcccaggaagtgagccgactgcgatctgagctggggggcaccgacttgg

SEQ ID NO: 7638 - DNA, 186 bp, synthetic construct
  misc_feature 1..186: note = Synthetic polypeptide
  source 1..186: mol_type = other DNA
cgtggtgggcaagagcatgagcttggaaccggaggcctcgatcctcgccagctgtgtggcctcagggtcccgacggcctacacatggggcgctgtgggcgccgtggggctggtgtgggccaccgattggcggctgatcctggactgggtaccttacatcaatggcaagtttaagaaggataattaa

SEQ ID NO: 7639 - DNA, 163 bp, synthetic construct; identical to SEQ ID NO: 480
  misc_feature 1..163: note = Synthetic polypeptide
  source 1..163: mol_type = other DNA

SEQ ID NO: 7640 - DNA, 104 bp, synthetic construct; identical to SEQ ID NO: 481
  misc_feature 1..104: note = Synthetic polypeptide
  source 1..104: mol_type = other DNA

SEQ ID NO: 7641 - DNA, 820 bp, synthetic construct
  misc_feature 1..820: note = Synthetic polypeptide
  source 1..820: mol_type = other DNA
gagaggtcggatctttaagatgtaattaggtcatgagaactccaccatcataaacagattactgctgttatcatgggagtggtttggttatcaagagactgggtttgttataaaagtgagttctccggatttcctctctgacttactcactgctgccttccaccatcagatgatcctcaccagatgccagcataatattcttggatttgcctgcctctagaagtaatcccaacagaaggccaaagaagtttgccccatgtactttatgaagctccgctctggccttatgataaaaaaggaggcctgttactttaggagagaaaccaccaaaaggccttcactgaaaacaggtagaaagcacaaaagacatctggtactcgctgcctgtcaacagcagtctactgtggagtgctttgcctttggtatatcaggggtccagaaatatactagagcacttcatgattcaagtatcacagataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttag

SEQ ID NO: 7642 - DNA, 946 bp, synthetic construct
  misc_feature 1..946: note = Synthetic polypeptide
  source 1..946: mol_type = other DNA
gagaggtcggatctttaagatgtaattaggtcatgagaactccaccatcataaacagattactgctgttatcatgggagtggtttggttatcaagagactgggtttgttataaaagtgagttctccggatttcctctctgacttactcactgctgccttccaccatcagatgatcctcaccagatgccagcataatattcttggatttgcctgcctctagaagtaatcccaacagaaggccaaagaagtttgccccatgtactttatgaagctccgctctggccttatgataaaaaaggaggcctgttactttaggagagaaaccaccaaaaggccttcactgaaaacaggtagaaagcacaaaagacatctggtactcgctgcctgtcaacagcagtctactgtggagtgctttgcctttggtatatcaggggtccagaaatatactagagcacttcatgattcaagtatcacaggaatttcacctattacagagtatcttgcttctctaagcacatacaatgatcaatccattacttttgctttggaggatgaaagttatgagatatatgttgaagacttgaaaaaagatgaaaagaaagataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttag

SEQ ID NO: 7643 - DNA, 1267 bp, synthetic construct; identical to SEQ ID NO: 463
  misc_feature 1..1267: note = Synthetic polypeptide
  source 1..1267: mol_type = other DNA

SEQ ID NO: 7644 - DNA, 382 bp, synthetic construct; identical to SEQ ID NO: 434
  misc_feature 1..382: note = Synthetic polypeptide
  source 1..382: mol_type = other DNA

SEQ ID NO: 7645 - DNA, 1086 bp, synthetic construct; identical to SEQ ID NO: 6423
  misc_feature 1..1086: note = Synthetic polypeptide
  source 1..1086: mol_type = other DNA

SEQ ID NO: 7646 - DNA, 2419 bp, synthetic construct; identical to SEQ ID NO: 7455
  misc_feature 1..2419: note = Synthetic polypeptide
  source 1..2419: mol_type = other DNA

SEQ ID NO: 7647 - DNA, 742 bp, synthetic construct; identical to SEQ ID NO: 6357
  misc_feature 1..742: note = Synthetic polypeptide
  source 1..742: mol_type = other DNA

SEQ ID NO: 7648 - DNA, 590 bp, synthetic construct; identical to SEQ ID NO: 6358
  misc_feature 1..590: note = Synthetic polypeptide
  source 1..590: mol_type = other DNA

SEQ ID NO: 7649 - DNA, 577 bp, synthetic construct; identical to SEQ ID NO: 6359
  misc_feature 1..577: note = Synthetic polypeptide
  source 1..577: mol_type = other DNA

SEQ ID NO: 7650 - DNA, 430 bp, synthetic construct; identical to SEQ ID NO: 6360
  misc_feature 1..430: note = Synthetic polypeptide
  source 1..430: mol_type = other DNA

SEQ ID NO: 7651 - DNA, 670 bp, synthetic construct; identical to SEQ ID NO: 6361
  misc_feature 1..670: note = Synthetic polypeptide
  source 1..670: mol_type = other DNA

SEQ ID NO: 7652 - DNA, 1086 bp, synthetic construct; identical to SEQ ID NO: 444
  misc_feature 1..1086: note = Synthetic polypeptide
  source 1..1086: mol_type = other DNA

SEQ ID NO: 7653 - DNA, 564 bp, synthetic construct; identical to SEQ ID NO: 445
  misc_feature 1..564: note = Synthetic polypeptide
  source 1..564: mol_type = other DNA

SEQ ID NO: 7654 - DNA, 987 bp, synthetic construct; identical to SEQ ID NO: 446
  misc_feature 1..987: note = Synthetic polypeptide
  source 1..987: mol_type = other DNA

SEQ ID NO: 7655 - DNA, 1138 bp, synthetic construct
  misc_feature 1..1138: note = Synthetic polypeptide
  source 1..1138: mol_type = other DNA
tgttataggaaatagaaataaagtatttgggtagacggggagaagagagtccctggcagaaaactttccttctaacataaagtagctcagaaatagctcccttctaacctcatgcagttcaaagaaatcacttctctaactaaacaagcagcctgaaagatcaggctgtaaatcacagataaacccctggagcacagaaggagggcggggagtctcctgggtaatcaccaaacttcacaatgggccccagtaaaaacagtgggccttaataagcacattcctttccctttaggacatcaagatagagaagctaaaagtggacttggggaggtgggggtggagacgtcgtgggggaggggtgttggggggatgcctgcagctgcaagaagatgtctgggaacagacacagaaactctccctctcagataagcaaaagaaggcatcacagactaagtctgcccatgtgatccaggaataaagtgagagctgataaaaaaaaaaactctgctctataaagatagcacacctggtcccaactaaatcgtcaggccctaggaggataagacatcccctcctcactggcaccacccccgccacctgccactaactccctcctcactagcccatttataaaaaccctgacatttttactaagcaactcactcgggacccatctcttcaagggagagctgttctttctttttgcctattcaactttgctccaaactcaagtctgtgtgtgtagtgtgtgttcgcgacctccgtctccttgactgttcgaccaagagccttggtaagaagtttgatagctgtaggactgggtgttgcagctcttgcatttgcaggtcgctacgcatttcggatctggaaacctctagaacaagttatcacagaaactgcaaagaagatttcaactcctagcttttcatcctactataaaggaggatttgaacagaaaatgagtaggcgagaagctggtcttattttaggtgtaagcccatctgctggcaaggctaagattagaacagctcataggagagtcatgattttgaatcacccagataaaggtggatctccttacgtagcagccaaaataaatgaagcaaaagacttgctagaaacaaccaccaaacattga

SEQ ID NO: 7656 - DNA, 3021 bp, synthetic construct; identical to SEQ ID NO: 449
  misc_feature 1..3021: note = Synthetic polypeptide
  source 1..3021: mol_type = other DNA

SEQ ID NO: 7657 - DNA, 3075 bp, synthetic construct; identical to SEQ ID NO: 450
  misc_feature 1..3075: note = Synthetic polypeptide
  source 1..3075: mol_type = other DNA

SEQ ID NO: 7658 - DNA, 1143 bp, synthetic construct; identical to SEQ ID NO: 451
  misc_feature 1..1143: note = Synthetic polypeptide
  source 1..1143: mol_type = other DNA

SEQ ID NO: 7659 - DNA, 470 bp, synthetic construct
  misc_feature 1..470: note = Synthetic polypeptide
  source 1..470: mol_type = other DNA
gccatgttgatttctcattagccccagtctcgtgaatgcctcctgattctgattttatttactgtttttagtgtaagaacaaagcagccttgatcttaccacacaaattataggcagtgacgcacatagcattcccacctgttctggaggatgcctttaattgcctctgtagagcacgtacaccctttccctgtggcatataagctctgggtctggccagtaacagagtgggttatacctgtcttgcagccatccgagatcacgcttcttgtctttctcgagaagcaggtggaaacatgagcattcagtttcttggtacagtggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatga

SEQ ID NO: 7660 - DNA, 611 bp, synthetic construct
  misc_feature 1..611: note = Synthetic polypeptide
  source 1..611: mol_type = other DNA
gccatgttgatttctcattagccccagtctcgtgaatgcctcctgattctgattttatttactgtttttagtgtaagaacaaagcagccttgatcttaccacacaaattataggcagtgacgcacatagcattcccacctgttctggaggatgcctttaattgcctctgtagagcacgtacaccctttccctgtggcatataagctctgggtctggccagtaacagagtgggttatacctgtcttgcagccatccgagatcacgcttcttgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatga

SEQ ID NO: 7661 - DNA, 347 bp, synthetic construct
  misc_feature 1..347: note = Synthetic polypeptide
  source 1..347: mol_type = other DNA
gccatgttgatttctcattagccccagtctcgtgaatgcctcctgattctgattttatttactgtttttagtgtaagaacaaagcagccttgatcttaccacacaaattataggcagtgacgcacatagcattcccacctgttctggaggatgcctttaattgcctctgtagagcacgtacaccctttccctgtggcatataagctctgggtctggccagtaacagagtgggttatacctgtcttgcagccatccgagatcacgcttcttgtctttctcgagaagcaggtggaaacatgagcattcagtttcttggtacagtgccctggagaaagcttctggattga

SEQ ID NO: 7662 - DNA, 2319 bp, synthetic construct; identical to SEQ ID NO: 6366
  misc_feature 1..2319: note = Synthetic polypeptide
  source 1..2319: mol_type = other DNA

SEQ ID NO: 7663 - DNA, 366 bp, synthetic construct
  misc_feature 1..366: note = Synthetic polypeptide
  source 1..366: mol_type = other DNA
agcatgggcaacaaagagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatag

SEQ ID NO: 7664 - DNA, 999 bp, synthetic construct
  misc_feature 1..999: note = Synthetic polypeptide
  source 1..999: mol_type = other DNA
gggcaggaaatgtataagagaagctggaaaatcttgtcacaccagaaagcaaagaaactgtcaaagaccaatgtactcatttcagaaagactcaggacccacttgaaaggtctcccactagtcaaagatgatataatttgatttaaaaaacaaataaatgattaaaacacctaaaatatgttaaaatctgtaaggtcataatgataatcataataacaaacctggtagtcccttttataggatgctagagcaccaaatcactattcacaaaactgataaataggaagaagtaagcatttaccctgttccctgtacaaattatacttcaaagtcaccaattaattgatgaaagaaaactttacagaagaattgtaactaatatattagaaggattatagaataatattatcatcatttgagtttcaacacattcattaacccttataccacagaaagatgcaagaagagcaaaccaccacctctggggcatccttgtcaaaaaattgaacctgaatctgatcaagtctctagttagaactactagtttgcaagaaatacagagggcagagaaacatgttaaatgacaccataaggctgcaatcacaaaaatccaaaatgtgagaaatgctacaggacaaagaacccagtttctttaacaaatgaattgcaaggagaaaagaaagaagagtatgctgtgaattaatagatttgaggaacatcaaataaaatgggatgaagtgtcctcttgctagcaccaataaaagatttctaattaacacaattaaaaacacattgccctctcataaagagcaagaccatgaacaaaaagagggcgataaggaaccagcgaagagccaggcccagaaagaagaaaacccgaagaaacacagaagccatccttacaagcacagcttccgcgctcgaggttccgccagttactccccgccacgaaagcggagcagccaggacaagtacgaaaagcggtccaaccggcggtga

SEQ ID NO: 7665 - DNA, 527 bp, synthetic construct
  misc_feature 1..527: note = Synthetic polypeptide
  source 1..527: mol_type = other DNA
ggctgggtgcggtggctcacgcctgtaatcccagcactttgggaggttgaggcaggtggatcacctgaggtcaggagttcgacaccagcctggccaatatagtgaaaccctgtctctagtaaaaatacaattagctgggcgtggtggcgggtgcctgtaatccagctactccggaggctgaggcaggagaatcgcttgaacctgggagacagaggttatgccactggacggatgtccaggtgaaggggacgtcgctgccccgagcactgcactgctgggacaggagcctccatgacagccacaaggccagcaagacccccctcaagggctgccccgtccacctggtggacagctgcccctggccccactgcaacccctcatgccccaccgtccgagaccagttcacggggcaagagatgaacgtggcccagttcctcatgcacatgggcttcgacatgcagacggtggcccagccgcagggactggagcccagtgagctgctggggatgctgagcaacggaagctag

SEQ ID NO: 7666 - DNA, 451 bp, synthetic construct
  misc_feature 1..451: note = Synthetic polypeptide
  source 1..451: mol_type = other DNA
tggaaccttgtgcagagggaagagtaaaaagacctccacacggcccactctgtccaccatctttgctccaaaagtccctaccctggaagtaccggcaccagaagccgtatcctcagggcactcaacgctgcctccccttgtgtcccggcctggaagtgccgacacgcccagtgaggccgaacagaggttccggaagaagcggaggcggtcacagcggaggccgcgactccggcaattcagcgatctgtgggtccgcctggaggagagtgacatagtcccgcaactccaggtccctgtcctggacaggcacatctccactgaactgcggctccctcgccgtgggcattcccaccacagccagatggtggccagcagtgcctgcctgtctctctggactcctgtgttctgggtgctggtgctggctttccaaacagagacacccctcctgtaa

SEQ ID NO: 7667 - DNA, 769 bp, synthetic construct; identical to SEQ ID NO: 6486
  misc_feature 1..769: note = Synthetic polypeptide
  source 1..769: mol_type = other DNA

SEQ ID NO: 7668 - DNA, 161 bp, synthetic construct
  misc_feature 1..161: note = Synthetic polypeptide
  source 1..161: mol_type = other DNA
aagaacatcatggtgcagtaaaagaagcctggcctttggagtcagaacagcagggtgacttggggtcagacccagagcaccccatttccttctctgtaagatgaggataataagagtaacaaccttttagggttaagcccctgtctatcaaaagttattag

SEQ ID NO: 7669 - DNA, 178 bp, synthetic construct
  misc_feature 1..178: note = Synthetic polypeptide
  source 1..178: mol_type = other DNA
aagaacatcatggtgcagtaaaagaagcctggcctttggagtcagaacagcagggtgacttggggtcagacccagagcaccccatttccttctctgtaagatgaggataataagagtaacaaccttttagggttaagcccctgtctatcaaaagttattagagaggatgaagcattag

SEQ ID NO: 7670 - DNA, 1206 bp, synthetic construct
  misc_feature 1..1206: note = Synthetic polypeptide
  source 1..1206: mol_type = other DNA
tgatatggtttggctgtgtccccattcaaatctccacagagttgtatctcccagaattcccacatgttgtgggagggacccagggggaggtaattgaatcatggaggccggtctttcccatgctattctcgtgatagtgaataagtctcacgagatccgataggtttatcaggggtttccgcttttgcttcttccttattctttcttgctgccaccatgtaagaagtgccttttgctcttcgccatgattatgagacctccccagccatgtggaactgagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatgagaaccactggatatctgtatattccggctttggcagcgttgcactctcccagttctctactctcccctcaggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactga

SEQ ID NO: 7671 - DNA, 1134 bp, synthetic construct
  misc_feature 1..1134: note = Synthetic polypeptide
  source 1..1134: mol_type = other DNA
tgatatggtttggctgtgtccccattcaaatctccacagagttgtatctcccagaattcccacatgttgtgggagggacccagggggaggtaattgaatcatggaggccggtctttcccatgctattctcgtgatagtgaataagtctcacgagatccgataggtttatcaggggtttccgcttttgcttcttccttattctttcttgctgccaccatgtaagaagtgccttttgctcttcgccatgattatgagacctccccagccatgtggaactgagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactga

SEQ ID NO: 7672 - DNA, 1002 bp, synthetic construct
  misc_feature 1..1002: note = Synthetic polypeptide
  source 1..1002: mol_type = other DNA
tgatatggtttggctgtgtccccattcaaatctccacagagttgtatctcccagaattcccacatgttgtgggagggacccagggggaggtaattgaatcatggaggccggtctttcccatgctattctcgtgatagtgaataagtctcacgagatccgataggtttatcaggggtttccgcttttgcttcttccttattctttcttgctgccaccatgtaagaagtgccttttgctcttcgccatgattatgagacctccccagccatgtggaactgagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacagtgggggaaatag

SEQ ID NO: 7673 - DNA, 279 bp, synthetic construct
  misc_feature 1..279: note = Synthetic polypeptide
  source 1..279: mol_type = other DNA
ttccccctcatctgaggtttcactttccacagtttcagttaccagaggtccaccacagtctgaatgtattaaataggaaattccagaagcaaacagttcataacctttaaagcacgcgccgttctgcacagtctggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctga

SEQ ID NO: 7674 - DNA, 543 bp, synthetic construct; identical to SEQ ID NO: 6496
  misc_feature 1..543: note = Synthetic polypeptide
  source 1..543: mol_type = other DNA

SEQ ID NO: 7675 - DNA, 378 bp, synthetic construct; identical to SEQ ID NO: 6497
  misc_feature 1..378: note = Synthetic polypeptide
  source 1..378: mol_type = other DNA

SEQ ID NO: 7676 - DNA, 267 bp, synthetic construct; identical to SEQ ID NO: 6498
  misc_feature 1..267: note = Synthetic polypeptide
  source 1..267: mol_type = other DNA

SEQ ID NO: 7677 - DNA, 416 bp, synthetic construct; identical to SEQ ID NO: 6499
  misc_feature 1..416: note = Synthetic polypeptide
  source 1..416: mol_type = other DNA

SEQ ID NO: 7678 - DNA, 162 bp, synthetic construct; identical to SEQ ID NO: 6500
  misc_feature 1..162: note = Synthetic polypeptide
  source 1..162: mol_type = other DNA

SEQ ID NO: 7679 - DNA, 1926 bp, synthetic construct
  misc_feature 1..1926: note = Synthetic polypeptide
  source 1..1926: mol_type = other DNA
gctggtgcggctgtgcgggcggggccggaagtgtggggacagcgcggggccgagaaccggaagtgcggggcgggcgcgggggcagagcgaaaggcttgaggaccagcccaggtggggaagacgtcgctgatcctgtccctggtgggcgaggagttccccgaggaggtccctccccgcgcggaggagatcaccatccccgcggacgtcaccccggagaaggtgcccacccacatcgtggactactcagaagccgagcagacggacgaggagctgcgggaggagatccacaaggcaaacgtggtgtgtgtggtgtatgacgtctctgaggaggccaccattgagaagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagttgaggcccgcgtgcgcccaggcgctgacgcgcatcttcaggctctcagatcaggacctggaccaggcgctcagtgacgaagagctcaacgctttccagaaatcctgctttgggcaccccctggccccgcaggccctggaggacgtgaagacggtggtgtgcaggaacgtggcgggcggcgtgcgggaggaccggctgaccctggatggtttcctcttcctgaacacgctcttcatccagcgcggccggcacgagaccacctggaccatcctgcggcgcttcggctacagcgatgccctggagctgactgcggactatctctcccctctgatccacgtgccccccggctgcagcacggagctcaaccaccttggctaccagtttgtgcagagagtgtttgagaagcacgaccaggaccgcgacggcgccctctcgcccgtggagctgcaaagccttttcagtgtgttcccagcagcgccctggggccccgagctcccacgcacagtccgcacagaggccggccggttgcccctgcacggatacctctgccagtggaccctggtgacctacctggacgtccggagctgccttggacacctaggctacctgggctaccccaccctctgtgagcaggaccaggcccatgccatcacagtcactcgtgagaagaggctggaccaggagaagggacagacgcagcggagcgtcctcctgtgcaaggtggtaggggcccgtggagtgggcaagtctgccttcctgcaggcctttctcggccgcggcctggggcaccaggacacgagggagcagcctcccggctacgccatcgacacggtgcaggtcaatggacaggagaagtacttgatcctctgtgaggtgggcacagatggtctgctggccacatcgctggacgccacctgtgacgttgcctgcttgatgtttgatggcagtgacccaaagtcctttgcacattgtgccagcgtctacaagcaccattacatggacgggcagaccccctgcctctttgtctcctccaaggccgacctgcccgaaggtgtcgcggtgtctggcccatcaccggccgagttttgccgcaagcaccggctacccgctcccgtgccgttctcctgtgctggcccagccgagcccagcaccaccatcttcacccagctcgccaccatggccgccttcccacatttggtccacgcagagctgcatccctcttccttctggctccgggggctgctgggggttgtcggggccgccgtggccgcagtcctcagcttctcactctacagggtcctggtgaagagccagtga

SEQ ID NO: 7680 - DNA, 477 bp, synthetic construct
  misc_feature 1..477: note = Synthetic polypeptide
  source 1..477: mol_type = other DNA
gctggtgcggctgtgcgggcggggccggaagtgtggggacagcgcggggccgagaaccggaagtgcggggcgggcgcgggggcagagcgaaaggcttgaggaccagcccaggtggggaagacgtcgctgatcctgtccctggtgggcgaggagttccccgaggaggtccctccccgcgcggaggagatcaccatccccgcggacgtcaccccggagaaggtgcccacccacatcgtggactactcagaagccgagcagacggacgaggagctgcgggaggagatccacaaggcaaacgtggtgtgtgtggtgtatgacgtctctgaggaggccaccattgagaagattcgaactaagtggatcccactggtgaatggggggaccacgcaggggcccagtgggcaacaagtcagacctgcggtcggggagctccatggaggccgtgctccccatcatgagccagtttcccgagattga

SEQ ID NO: 7681 - DNA, 711 bp, synthetic construct
  misc_feature 1..711: note = Synthetic polypeptide
  source 1..711: mol_type = other DNA
gctggtgcggctgtgcgggcggggccggaagtgtggggacagcgcggggccgagaaccggaagtgcggggcgggcgcgggggcagagcgaaaggcttgaggaccagcccaggtggggaagacgtcgctgatcctgtccctggtgggcgaggagttccccgaggaggtccctccccgcgcggaggagatcaccatccccgcggacgtcaccccggagaaggtgcccacccacatcgtggactactcagaagccgagcagacggacgaggagctgcgggaggagatccacaaggcaaacgtggtgtgtgtggtgtatgacgtctctgaggaggccaccattgagaagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagaaatcctgctttgggcaccccctggccccgcaggccctggaggacgtgaagacggtggtgtgcaggaacgtggcgggcggcgtgcgggaggaccggctgacc

SEQ ID NO: 7682 - DNA, 288 bp, synthetic construct
  misc_feature 1..288: note = Synthetic polypeptide
  source 1..288: mol_type = other DNA
gctggtgcggctgtgcgggcggggccggaagtgtggggacagcgcggggccgagaaccggaagtgcggggcgggcgcgggggcagagcgaaaggcttgaggaccagcccaggtggggaagacgtcgctgatcctgtccctggtgggcgaggagttccccgaggagccgagcagacggacgaggagctgcgggaggagatccacaaggcaaacgtggtgtgtgtggtgtatgacgtctctgaggaggccaccattgagaagattcgaactaagtggatcccactggtga

SEQ ID NO: 7683 - DNA, 237 bp, synthetic construct
  misc_feature 1..237: note = Synthetic polypeptide
  source 1..237: mol_type = other DNA
gctggtgcggctgtgcgggcggggccggaagtgtggggacagcgcggggccgagaaccggaagtgcggggcgggcgcgggggcagagcgaaaggcttgaggaccagcccaggtggggaagacgtcgctgatcctgtccctggtgggcgaggagttccccgaggagaagccgagcagacggacgaggagctgcgggaggagatccacaagattcgaactaagtggatcccactggtga

SEQ ID NO: 7684 - DNA, 703 bp, synthetic construct
  misc_feature 1..703: note = Synthetic polypeptide
  source 1..703: mol_type = other DNA
gctggtgcggctgtgcgggcggggccggaagtgtggggacagcgcggggccgagaaccggaagtgcggggcgggcgcgggggcagagcgaaaggcttgaggaccagcccaggtggggaagacgtcgctgatcctgtccctggtgggcgaggagttccccgaggaggtccctccccgcgcggaggagatcaccatccccgcggacgtcaccccggagaaggtgcccacccacatcgtggactactcagaagccgagcagacggacgaggagctgcgggaggagatccacaagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagttgaggcccgcgtgcgcccaggcgctgacgcgcatcttcaggctctcagatcaggacctggaccaggcgctcagtgacgaagagctcaacgctttccagaaatcctgctttgggcaccccctggccccgcaggccctggaggacgtga

SEQ ID NO: 7685 - DNA, 1983 bp, synthetic construct
  misc_feature 1..1983: note = Synthetic polypeptide
  source 1..1983: mol_type = other DNA
cccagcaacctctctgaccacgttccctgcccctctttttgctttttgctaagctgccagccactgacctcctgactgctcctctgacatcccccaggtgccctcgctaaaatttcacctctttcatcgccctgctcctcacctctccaagggactcctgccagcagcctggtcagcaaaatttctgcagtgcagtttccagaatctgctgacacaactgccaaacaaagcctaggttctcacagggccttaacttacactcagagtgccccagacctatcccctcaaatcctgactccacctgttatatgtagcagctgtggcagaccatattcccaagggaatcctgctgatgagcccctggagagaagtggggtagccactcggacaccaagtagaacagatgacactgctcaagttacctctgattatgaaaccaataacaacagtgacagcagtgacattgtacagaatgaagatgaaacagagtgcctgagagagcctctgaggaaagcatcggcttgcagcacctatgctcctgagaccatgatgtttctggacaaaccaattcttgctcccgaacctcttgtcatggataacctggactcaattatggagcagctaaatacttggaattttccaatttttgatttagtggaaaatataggaagaaaatgtggccgtattcttagtcaggtatcttacagactttttgaagacatgggcctctttgaagcttttaaaattccaattagggaatttatgaattattttcatgctttggagattggatatagggatattccttatcataacagaatccatgccactgatgttttacatgctgtttggtatcttactacacagcctattccaggcctctcaactgtgattaatgatcatggttcaaccagtgattcagattctgacagtggatttacacatggacatatgggatatgtattctcaaaaacgtataatgtgacagatgataaatacggatgtctgtctgggaatatccctgccttggagttgatggcgctgtatgtggctgcagccatgcacgattatgatcatccaggaaggactaatgctttcctggttgcaactagtgctcctcaggcggtgctatataacgatcgttcagttttggagaatcatcacgcagctgctgcatggaatcttttcatgtcccggccagagtataacttcttaattaaccttgaccatgtggaatttaagcatttccgtttccttgtcattgaagcaattttggccactgacctgaagaaacactttgacttcgtagccaaatttaatggcaaggtaaatgatgatgttggaatagattggaccaatgaaaatgatcgtctactggtttgtcaaatgtgtataaagttggctgatatcaatggtccagctaaatgtaaagaactccatcttcagtggacagatggtattgtcaatgaattttatgaacagggtgatgaagaggccagccttggattacccataagccccttcatggatcgttctgctcctcagctggccaaccttcaggaatccttcatctctcacattgtggggcctctgtgcaactcctatgattcagcaggactaatgcctggaaaatgggtggaagacagcgatgagtcaggagatactgatgacccagaagaagaggaggaagaagcaccagcaccaaatgaagaggaaacctgtgaaaataatgaatctccaaaaaagaagactttcaaaaggagaaaaatctactgccaaataactcagcacctcttacagaaccacaagatgtggaagaaagtcattgaagaggagcaacggttggcaggcatagaaaatcaatccctggaccagacccctcagtcgcactcttcagaacagatccaggctatcaaggaagaagaagaagagaaagggaaaccaagaggcgaggagataccaacccaaaagccagaccagtga

SEQ ID NO: 7686 - DNA, 1325 bp, synthetic construct
  misc_feature 1..1325: note = Synthetic polypeptide
  source 1..1325: mol_type = other DNA
tatctagtctatgatccaaaaagtttcactcctaggtatttacccaagagaaatgagaatatatgtctgcaaaaagacctgtacagtgtgtccatagctgtcttattcatagtagcctcaaaatggacacaactcaagggcccgtcgaaagcagaggcaaatcatggtgtgtccctgcatcgtgaagagaaacaaagggctgatgcaacatgaggacgtctcaaagacaagttgcacttaagaagctatgctaagaaaacaaacacacagaagcctacatcattacatgtatagaatgttcaagaactgatgaaaccagtccgtggtcacaaaagccagaaagtggttgcttctggggaccagaagggaaaggggcataaaggaaccttttgaggtgaatagaagtttctgcatcttggtttggcacacatgccaaaactcaccagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagaaattgcaggtgctgcagtgtctgaaatttccgggcctttctcaacagaggatgtag

SEQ ID NO: 7687 - DNA, 1691 bp, synthetic construct
  misc_feature 1..1691: note = Synthetic polypeptide
  source 1..1691: mol_type = other DNA
tatctagtctatgatccaaaaagtttcactcctaggtatttacccaagagaaatgagaatatatgtctgcaaaaagacctgtacagtgtgtccatagctgtcttattcatagtagcctcaaaatggacacaactcaagggcccgtcgaaagcagaggcaaatcatggtgtgtccctgcatcgtgaagagaaacaaagggctgatgcaacatgaggacgtctcaaagacaagttgcacttaagaagctatgctaagaaaacaaacacacagaagcctacatcattacatgtatagaatgttcaagaactgatgaaaccagtccgtggtcacaaaagccagaaagtggttgcttctggggaccagaagggaaaggggcataaaggaaccttttgaggtgaatagaagtttctgcatcttggtttggcacacatgccaaaactcaccagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatga

SEQ ID NO: 7688 - DNA, 1541 bp, synthetic construct
  misc_feature 1..1541: note = Synthetic polypeptide
  source 1..1541: mol_type = other DNA
tatctagtctatgatccaaaaagtttcactcctaggtatttacccaagagaaatgagaatatatgtctgcaaaaagacctgtacagtgtgtccatagctgtcttattcatagtagcctcaaaatggacacaactcaagggcccgtcgaaagcagaggcaaatcatggtgtgtccctgcatcgtgaagagaaacaaagggctgatgcaacatgaggacgtctcaaagacaagttgcacttaagaagctatgctaagaaaacaaacacacagaagcctacatcattacatgtatagaatgttcaagaactgatgaaaccagtccgtggtcacaaaagccagaaagtggttgcttctggggaccagaagggaaaggggcataaaggaaccttttgaggtgaatagaagtttctgcatcttggtttggcacacatgccaaaactcaccagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatga

SEQ ID NO: 7689 - DNA, 567 bp, synthetic construct
  misc_feature 1..567: note = Synthetic polypeptide
  source 1..567: mol_type = other DNA
gtttgatgtccaggctatccccttagctttgtgacttcaggtcatttcatgggcaacaacacagtgctggatgttttgcggcgtgaaggctatgaggtagaacacgcccctgctggacgacccatccacaaagggaagagtaaaaagacctccacacggcccactctgtccaccatctttgctccaaaagtccctaccctggaagtaccggcaccagaagccgtatcctcagggcactcaacgctgcctccccttgtgtcccggcctggaagtgccgacacgcccagtgaggccgaacagaggttccggaagaagcggaggcggtcacagcggaggccgcgactccggcaattcagcgatctgtgggtccgcctggaggagagtgacatagtcccgcaactccaggtccctgtcctggacaggcacatctccactgaactgcggctccctcgccgtgggcattcccaccacagccagatggtggccagcagtgcctgcctgtctctctggactcctgtgttctgggtgctggtgctggctttccaaacagagacacccctcctgtaa

SEQ ID NO: 7690 - DNA, 2564 bp, synthetic construct
  misc_feature 1..2564: note = Synthetic polypeptide
  source 1..2564: mol_type = other DNA
tacaaggaggaactggtaccattcttctgaaactatttcaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacctttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaattaggcaggagaaggaaataaagggtattcaattaggaaaagaggaagtcaaattgtccctgtttgcagatgacatgattgtatatctagaaaaccccatcgtctcagcccaaaatctccttaagctaataagcaacttcagcaaagtctcaggatacaaaatcaatgtacagaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccgctgctcaaggaaataaaagaggatacaaacaaatggaagaacattccatactcatggataggaagaatcaatatcgtgaaaatggccatactgcccaagtcaacattggcctgtgcccgagcgtctgctctctgcttgaattttaacagcacgctgatcctgcttcctgtgtgtcgcaatctgctgtccttcctgaggggcacctgctcattttgcagccgcacactgagaaagcaattggatcacaacctcaccttccacaagctggtggcctatatgatctgcctacatacagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacacgacagtggagtatgtgacattcaccagcattgctggtctcactggagtgatcatgacaatagccttgattctcatggtaacttcagctactgagttcatccggaggagttattttgaagtcttctggtatactcaccacctttttatcttctatatccttggcttagggattcacggcattggtggaattgtccggggtcaaacagaggagagcatgaatgagagtcatcctcgcaagtgtgcagagtcttttgagatgtgggatgatcgtgactcccactgtaggcgccctaagtttgaagggcatccccctgagtcttggaagtggatccttgcaccggtcattctttatatctgtgaaaggatcctccggttttaccgctcccagcagaaggttgtgattaccaaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaagatctatttctactggatctgcagggagacaggtgccttttcctggttcaacaacctgttgacttccctggaacaggagatggaggaattaggcaaagtgggttttctaaactaccgtctcttcctcaccggatgggacagcaatattgttggtcatgcagcattaaactttgacaaggccactgacatcgtgacaggtctgaaacagaaaacctcctttgggagaccaatgtgggacaatgagttttctacaatagctacctcccaccccaagtctgtagtgggagttttcttatgtggccctcggactttggcaaagagcctgcgcaaatgctgtcaccgatattccagtctggatcctagaaaggttcaattctacttcaacaaagaaaatttttga

SEQ ID NO: 7691 - DNA, 1448 bp, synthetic construct
  misc_feature 1..1448: note = Synthetic polypeptide
  source 1..1448: mol_type = other DNA
tacaaggaggaactggtaccattcttctgaaactatttcaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacctttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaattaggcaggagaaggaaataaagggtattcaattaggaaaagaggaagtcaaattgtccctgtttgcagatgacatgattgtatatctagaaaaccccatcgtctcagcccaaaatctccttaagctaataagcaacttcagcaaagtctcaggatacaaaatcaatgtacagaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccgctgctcaaggaaataaaagaggatacaaacaaatggaagaacattccatactcatggataggaagaatcaatatcgtgaaaatggccatactgcccaagtcaacattggcctgtgcccgagcgtctgctctctgcttgaattttaacagcacgctgatcctgcttcctgtgtgtcgcaatctgctgtccttcctgaggggcacctgctcattttgcagccgcacactgagaaagcaattggatcacaacctcaccttccacaagctggtggcctatatgatctgcctacatacagctattcacatcattgcacacctgtttaactttgactgctatagcagaagccgacaggccacagatggctcccttgcctccattctctccagcctatctcatgatgagaaaaaggggggttcttggctaaatcccatccatccccatataacaccaacagtgtacatgtttactgtcacttttgatatggtcttatccagtgtgaacagcaatttattcttatttttgctcatcaaaaaataa

SEQ ID NO: 7692 - DNA, 2417 bp, synthetic construct
  misc_feature 1..2417: note = Synthetic polypeptide
  source 1..2417: mol_type = other DNA
tacaaggaggaactggtaccattcttctgaaactatttcaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacctttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaattaggcaggagaaggaaataaagggtattcaattaggaaaagaggaagtcaaattgtccctgtttgcagatgacatgattgtatatctagaaaaccccatcgtctcagcccaaaatctccttaagctaataagcaacttcagcaaagtctcaggatacaaaatcaatgtacagaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccgctgctcaaggaaataaaagaggatacaaacaaatggaagaacattccatactcatggataggaagaatcaatatcgtgaaaatggccatactgcccaagtcaacattggcctgtgcccgagcgtctgctctctgcttgaattttaacagcacgctgatcctgcttcctgtgtgtcgcaatctgctgtccttcctgaggggcacctgctcattttgcagccgcacactgagaaagcaattggatcacaacctcaccttccacaagctggtggcctatatgatctgcctacatacagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacacgacagtggagtatgtgacattcaccagcattgctggtctcactggagtgatcatgacaatagccttgattctcatggtaacttcagctactgagttcatccggaggagttattttgaagtcttctggtatactcaccacctttttatcttctatatccttggcttagggattcacggcattggtggaattgtccggggtcaaacagaggagagcatgaatgagagtcatcctcgcaagtgtgcagagtcttttgagatgtgggatgatcgtgactcccactgtaggcgccctaagtttgaagggcatccccctgagtcttggaagtggatccttgcaccggtcattctttatatctgtgaaaggatcctccggttttaccgctcccagcagaaggttgtgattaccaaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaaggttggtcatgcagcattaaactttgacaaggccactgacatcgtgacaggtctgaaacagaaaacctcctttgggagaccaatgtgggacaatgagttttctacaatagctacctcccaccccaagtctgtagtgggagttttcttatgtggccctcggactttggcaaagagcctgcgcaaatgctgtcaccgatattccagtctggatcctagaaaggttcaattctacttcaacaaagaaaatttttga

SEQ ID NO: 7693 - DNA, 207 bp, synthetic construct
  misc_feature 1..207: note = Synthetic polypeptide
  source 1..207: mol_type = other DNA
cgcccccgcccctgcccccccacccctgcacaggtcctggtgatcttgtcccagctagagggcaacgccggcttctctatcacccaccgcctggcacatcgcaaggcagcccaggccttcctcagtgactggacagcctccaaggggacccacagccccccactcacgccagaggtcgccggtctgcatgggccccgaccgctgtga

SEQ ID NO: 7694 - DNA, 268 bp, synthetic construct
  misc_feature 1..268: note = Synthetic polypeptide
  source 1..268: mol_type = other DNA
cgcccccgcccctgcccccccacccctgcacaggtgccccctcccctaccccgctgcacccacacccaactcgtgcccccccacccctgcacaggtcctggtgatcttgtcccagctagagggcaacgccggcttctctatcacccaccgcctggcacatcgcaaggcagcccaggccttcctcagtgactggacagcctccaaggggacccacagccccccactcacgccagaggtcgccggtctgcatgggccccgaccgctgtga

SEQ ID NO: 7695 - DNA, 330 bp, synthetic construct; identical to SEQ ID NO: 6490
  misc_feature 1..330: note = Synthetic polypeptide
  source 1..330: mol_type = other DNA

SEQ ID NO: 7696 - DNA, 1461 bp, synthetic construct
  misc_feature 1..1461: note = Synthetic polypeptide
  source 1..1461: mol_type = other DNA
gtgaaaattactgagtcctgaacaggcaacttacattctaataccagctctgtctccatccagccgactgaatagtcgtgattaaatgctgagatgaatcgtcacctgtgtgtttggctttttagacatccatctcttaatggttacctccagtgtcacatccagctccattctcatcaatttagacagatacatcttgatacaaggctgcaagtttttagacaaaacaggaattgcattcttcatctgttaagtaagaattggtccaggagatattgccatcaagacaccaagatgctctggaagcataaagcactacagaaatatatggagaacctgagtaaggagtaccaaacacttgagcaatgtctgcagcatatccctgtgaatgaggaaaaccgaaggtccttgaacagaaggcatgctgagttggcacctcttgcagccatttaccaagaaattcaggagactgaacaagcaattgaagaattagaatcaatgtgtaaaagcctaaataaacaagatgaaaagcagttacaagaacttgcactggaagaaaggcaaaccattgatcaaaaaatcaacatgttgtacaatgagcttttccagagccttgtgccaaaggagaaatatgacaaaaatgatgttattttagaggtgacagctggaaggactactggaggtgacatctgccaacaatttacccgagaaatatttgacatgtaccagaattattcgtgctataaacactggcaatttgaacttctgaattatacaccagcagattatggtggactacatcatgcagccgcccgaatttccggtgacggtgtctataagcatttgaagtatgagggtgggattcaccgagttcagcgcatccccgaggtgggcctgtcctcaaggatgcagcgcattcacacaggaacgatgtcggttattgtccttcctcagccagatgaggtggatgtgaaattggaccccaaggatttgcgaatagatacatttcgagccaaaggagcaggagggcagcatgttaataaaactgatagtgccgtcagacttgtccacatccccacagggctagtagtagaatgccaacaagaaagatcacagataaaaaataaagaaatagcctttcgtgtgttgagagctagactctaccagcagattattgagaaagacaagcgtcagcaacaaagtgctagaaaactgcaggtgggaacaagagcccagtcagagcgaattcggacatataatttcacccaggatagagtcagtgaccacaggatagcatatgaagttcgtgatattaaggctcagtctcattccacgggtggtagtcgtgaccctgcacattccacattcctatccttggattctgtgagatcacctggtattctcattatgacttcttctgttaggaatttttatgtggtgggaagggcctggatcagctaa

SEQ ID NO: 7697 - DNA, 80 bp, synthetic construct; identical to SEQ ID NO: 6364
  misc_feature 1..80: note = Synthetic polypeptide
  source 1..80: mol_type = other DNA

SEQ ID NO: 7698 - DNA, 217 bp, synthetic construct; identical to SEQ ID NO: 6365
  misc_feature 1..217: note = Synthetic polypeptide
  source 1..217: mol_type = other DNA

SEQ ID NO: 7699 - DNA, 584 bp, synthetic construct
  misc_feature 1..584: note = Synthetic polypeptide
  source 1..584: mol_type = other DNA
gggggcctagtcgctgcggcatgcctgggacttgcctgccctcagcactgacacccctcagtcccaggcaaagtgggacaggccctgtgttcgtggtgcagtggctgtttgacgaggcacagctgacggtggacaacgtgcacctgacggggcagccggtgcaggagggcctgcggctgtacatccagaacctcggccgcgagctgcgccacacactcaaggacgtgccggccagctttgcccccgcctgcctctcccatgagatcatcatccggagccactggacggatgtccaggtgaaggggacgtcgctgccccgagcactgcactgctgggacaggagcctccatgacagccacaaggccagcaagacccccctcaagggctgccccgtccacctggtggacagctgcccctggccccactgcaacccctcatgccccaccgtccgagaccagttcacggggcaagagatgaacgtggcccagttcctcatgcacatgggcttcgacatgcagacggtggcccagccgcagggactggagcccagtgagctgctggggatgctgagcaacggaagctag

SEQ ID NO: 7700 - DNA, 111 bp, synthetic construct
  misc_feature 1..111: note = Synthetic polypeptide
  source 1..111: mol_type = other DNA
gggggcctagtcgctgcggcatgcctgggacttgcctgccctcagcactgacacccctcagtcccaggcaaagtgggacaggccctgtgttcgtggtgcagtggctgtttg

SEQ ID NO: 7701 - DNA, 404 bp, synthetic construct
  misc_feature 1..404: note = Synthetic polypeptide
  source 1..404: mol_type = other DNA
ggcgccggcgccggcggccgcggcgggcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaataggtgtgtatg

SEQ ID NO: 7702 - DNA, 336 bp, synthetic construct
  misc_feature 1..336: note = Synthetic polypeptide
  source 1..336: mol_type = other DNA
ggcgccggcgccggcggccgcggcgggcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacaca

SEQ ID NO: 7703 - DNA, 3325 bp, synthetic construct
  misc_feature 1..3325: note = Synthetic polypeptide
  source 1..3325: mol_type = other DNA
ggcgccggcgccggcggccgcggcgggcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtga

SEQ ID NO: 7704 - DNA, 169 bp, synthetic construct
  misc_feature 1..169: note = Synthetic polypeptide
  source 1..169: mol_type = other DNA
ggcgccggcgccggcggccgcggcgggcgcaatggcggcggccgcggcggagcagcaacagttctacctgctcctgggaaacctgctcagccccgacaatgtggtccggaaacaggcagaggaaacctatgagaatatcccaggccagtcaaagatcacattcctctta

SEQ ID NO: 7705 - DNA, 169 bp, synthetic construct
  misc_feature 1..169: note = Synthetic polypeptide
  source 1..169: mol_type = other DNA
ggcgccggcgccggcggccgcggcgggcgcaatggcggcggccgcggcggagcagcaacagttctacctgctcctgggaaacctgctcagccccgacaatgtggtccggaaacaggcagagacagatatgtttgaaaagtttgaaacctgtgtagcactgcataaatag

SEQ ID NO: 7706 - DNA, 241 bp, synthetic construct
  misc_feature 1..241: note = Synthetic polypeptide
  source 1..241: mol_type = other DNA
ggcgccggcgccggcggccgcggcgggcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttg

SEQ ID NO: 7707 - DNA, 273 bp, synthetic construct
  misc_feature 1..273: note = Synthetic polypeptide
  source 1..273: mol_type = other DNA
ggcgccggcgccggcggccgcggcgggcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcact

SEQ ID NO: 7708 - DNA, 329 bp, synthetic construct
  misc_feature 1..329: note = Synthetic polypeptide
  source 1..329: mol_type = other DNA
ggcgccggcgccggcggccgcggcgggcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatgg

SEQ ID NO: 7709 - DNA, 203 bp, synthetic construct
  misc_feature 1..203: note = Synthetic polypeptide
  source 1..203: mol_type = other DNA
ggcgccggcgccggcggccgcggcgggcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagagg

SEQ ID NO: 7710 - DNA, 271 bp, synthetic construct
  misc_feature 1..271: note = Synthetic polypeptide
  source 1..271: mol_type = other DNA
ggcgccggcgccggcggccgcggcgggcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagca

SEQ ID NO: 7711 - DNA, 297 bp, synthetic construct
  misc_feature 1..297: note = Synthetic polypeptide
  source 1..297: mol_type = other DNA
ggcgccggcgccggcggccgcggcgggcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccat

SEQ ID NO: 7712 - DNA, 127 bp, synthetic construct
  misc_feature 1..127: note = Synthetic polypeptide
  source 1..127: mol_type = other DNA
ggcgccggcgccggcggccgcggcgggcgcaatggcggcggccgcggcggagcagcaacagttctacctgctcctgggaaacctgctcagccccgacaatgtggtccggaaacaggcagaggtaacc

SEQ ID NO: 7713 - DNA, 333 bp, synthetic construct; identical to SEQ ID NO: 6583
  misc_feature 1..333: note = Synthetic polypeptide
  source 1..333: mol_type = other DNA

SEQ ID NO: 7714 - DNA, 342 bp, synthetic construct; identical to SEQ ID NO: 7076
  misc_feature 1..342: note = Synthetic polypeptide
  source 1..342: mol_type = other DNA

SEQ ID NO: 7715 - DNA, 1516 bp, synthetic construct; identical to SEQ ID NO: 7077
  misc_feature 1..1516: note = Synthetic polypeptide
  source 1..1516: mol_type = other DNA

SEQ ID NO: 7716 - DNA, 1444 bp, synthetic construct; identical to SEQ ID NO: 7078
  misc_feature 1..1444: note = Synthetic polypeptide
  source 1..1444: mol_type = other DNA

SEQ ID NO: 7717 - DNA, 1312 bp, synthetic construct; identical to SEQ ID NO: 7079
  misc_feature 1..1312: note = Synthetic polypeptide
  source 1..1312: mol_type = other DNA

SEQ ID NO: 7718 - DNA, 1775 bp, synthetic construct; identical to SEQ ID NO: 568
  misc_feature 1..1775: note = Synthetic polypeptide
  source 1..1775: mol_type = other DNA

SEQ ID NO: 7719 - DNA, 807 bp, synthetic construct; identical to SEQ ID NO: 7401
  misc_feature 1..807: note = Synthetic polypeptide
  source 1..807: mol_type = other DNA

SEQ ID NO: 7720 - DNA, 453 bp, synthetic construct; identical to SEQ ID NO: 7402
  misc_feature 1..453: note = Synthetic polypeptide
  source 1..453: mol_type = other DNA

SEQ ID NO: 7721 - DNA, 1609 bp, synthetic construct
  misc_feature 1..1609: note = Synthetic polypeptide
  source 1..1609: mol_type = other DNA
tagtgtccttaatatataaagaattgctacaagtcaaaaaaggtaaaggtcaacaacccaaaacaaatatttcatagaaaaatacagaaatctcttgaacagatgaaaacttcagcaacctcacttacggtaaaaaaaaaatgcaaaataaaactacaatatacaattttcactagtaataatgggaaagctcagagtttgcaaatgtatggtactggaaagaatgtagggaggcaggcattgtcacgcattgatgccaaaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggcgtaggagtatatttgctttcttaaccctgctaccctcatgtctttggactgattatcttttggcattttatattaatccttggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctag

SEQ ID NO: 7722 - DNA, 1525 bp, synthetic construct
  misc_feature 1..1525: note = Synthetic polypeptide
  source 1..1525: mol_type = other DNA
tagtgtccttaatatataaagaattgctacaagtcaaaaaaggtaaaggtcaacaacccaaaacaaatatttcatagaaaaatacagaaatctcttgaacagatgaaaacttcagcaacctcacttacggtaaaaaaaaaatgcaaaataaaactacaatatacaattttcactagtaataatgggaaagctcagagtttgcaaatgtatggtactggaaagaatgtagggaggcaggcattgtcacgcattgatgccaaaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctag

SEQ ID NO: 7723 - DNA, 436 bp, synthetic construct
  misc_feature 1..436: note = Synthetic polypeptide
  source 1..436: mol_type = other DNA
tagtgtccttaatatataaagaattgctacaagtcaaaaaaggtaaaggtcaacaacccaaaacaaatatttcatagaaaaatacagaaatctcttgaacagatgaaaacttcagcaacctcacttacggtaaaaaaaaaatgcaaaataaaactacaatatacaattttcactagtaataatgggaaagctcagagtttgcaaatgtatggtactggaaagaatgtagggaggcaggcattgtcacgcattgatgccaaaggaaccagttgctgtttcttcccatgtcgtgaccatctccagccttcttcctgccactgcctacaattgtagtgtcaccagctttagccatgacagccccagtgtccctacgttcatagccgtctcaacaatggggagtgtggagctggtacatttgtcaattttgcatccttag

SEQ ID NO: 7724 - DNA, 1022 bp, synthetic construct; identical to SEQ ID NO: 590
  misc_feature 1..1022: note = Synthetic polypeptide
  source 1..1022: mol_type = other DNA

SEQ ID NO: 7725 - DNA, 347 bp, synthetic construct; identical to SEQ ID NO: 591
  misc_feature 1..347: note = Synthetic polypeptide
  source 1..347: mol_type = other DNA

SEQ ID NO: 7726 - DNA, 1109 bp, synthetic construct; identical to SEQ ID NO: 592
  misc_feature 1..1109: note = Synthetic polypeptide
  source 1..1109: mol_type = other DNA

SEQ ID NO: 7727 - DNA, 85 bp, synthetic construct; identical to SEQ ID NO: 601
  misc_feature 1..85: note = Synthetic polypeptide
  source 1..85: mol_type = other DNA

SEQ ID NO: 7728 - DNA, 269 bp, synthetic construct; identical to SEQ ID NO: 600
  misc_feature 1..269: note = Synthetic polypeptide
  source 1..269: mol_type = other DNA

SEQ ID NO: 7729 - DNA, 1508 bp, synthetic construct
  misc_feature 1..1508: note = Synthetic polypeptide
  source 1..1508: mol_type = other DNA
tagctatgtggatcctgggcagattgtccatgttgctgggcctccgttgcttcactgtatgacgtctgcctctcagggatgcaggaagattcaattagatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggactcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccagtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactga

SEQ ID NO: 7730 - DNA, 603 bp, synthetic construct
  misc_feature 1..603: note = Synthetic polypeptide
  source 1..603: mol_type = other DNA
tagctatgtggatcctgggcagattgtccatgttgctgggcctccgttgcttcactgtatgacgtctgcctctcagggatgcaggaagattcaattagatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaag

SEQ ID NO: 7731 - DNA, 909 bp, synthetic construct
  misc_feature 1..909: note = Synthetic polypeptide
  source 1..909: mol_type = other DNA
tagctatgtggatcctgggcagattgtccatgttgctgggcctccgttgcttcactgtatgacgtctgcctctcagggatgcaggaagattcaattagatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctg

SEQ ID NO: 7732 - DNA, 1114 bp, synthetic construct
  misc_feature 1..1114: note = Synthetic polypeptide
  source 1..1114: mol_type = other DNA
agggaacaggaaactgagagtcaggaaaggttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaagtatgcatcggtttggtcctataccccttggttccttgggctggaagacagttaaacaaccagtatatgtcgtagatgtatccaaaggaattgttaatgcagttaaggatcctgatgccaatgggaaatcctttgctttcgttggtcccagtcggtacctccttttccacctggtgaagtacatctttgctgtggctcacagattgttcctcccattccccttgccgctttttgcctatcgatgggtagcaagagtctttgaaataagcccatttgagccctggataacaagggataaagtggagcggatgcacatcacagacatgaaattgcctcacctgcctggcttagaagaccttggtattcaggcaacaccactggaactcaaggccattgaggtgctgcggcgtcatcgcacttaccgctggctgtctgctgaaattgaggatgtgaagccggccaagaccgtcaacatttag

SEQ ID NO: 7733 - DNA, 363 bp, synthetic construct
  misc_feature 1..363: note = Synthetic polypeptide
  source 1..363: mol_type = other DNA
agggaacaggaaactgagagtcaggaaaggttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaa

SEQ ID NO: 7734 - DNA, 455 bp, synthetic construct
  misc_feature 1..455: note = Synthetic polypeptide
  source 1..455: mol_type = other DNA
tttggtgccgtgactcggatcgggggacctcccttgggagatcaatcccccatcctcctgctctttgctccatgagaaaaatccacctatgaccttaggtcctcagaccgaccagcccaagaaacatctcaccaatttcaaatccgatttaccggaacattccaggatttttacgtacacttatggatgccctgagaaaagacaaaataatctttcctaatgatgaaaatgttaaattcctttcttctcctcttctcatcttacatggagaggatgacaggacagtgcctttggagtatgggaaaaagctctatgaaattgcacgcaatgcatacaggaacaaagagagggtcaagatggttatctttcctcctggcttccaacacaacctgctttgtaaaagccccacactgttaataaccgtgagagatttcctgagcaagcagtggtcatga

SEQ ID NO: 7735 - DNA, 2465 bp, synthetic construct
  misc_feature 1..2465: note = Synthetic polypeptide
  source 1..2465: mol_type = other DNA
ggcagggtgcggtggctcacacctgtaatcccagcactttgggaggccaaggcgggcggatcacgaggtcaggagatcgagaccatcctggctaacacggtgaaatcccggctctactaaaaatacaaaaagtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggagtctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtag

SEQ ID NO: 7736 - DNA, 412 bp, synthetic construct
  misc_feature 1..412: note = Synthetic polypeptide
  source 1..412: mol_type = other DNA
ggcagggtgcggtggctcacacctgtaatcccagcactttgggaggccaaggcgggcggatcacgaggtcaggagatcgagaccatcctggctaacacggtgaaatcccggctctactaaaaatacaaaaagtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaa

SEQ ID NO: 7737 - DNA, 289 bp, synthetic construct
  misc_feature 1..289: note = Synthetic polypeptide
  source 1..289: mol_type = other DNA
ggcagggtgcggtggctcacacctgtaatcccagcactttgggaggccaaggcgggcggatcacgaggtcaggagatcgagaccatcctggctaacacggtgaaatcccggctctactaaaaatacaaaaagtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagca

SEQ ID NO: 7738 - DNA, 282 bp, synthetic construct
  misc_feature 1..282: note = Synthetic polypeptide
  source 1..282: mol_type = other DNA
ggcagggtgcggtggctcacacctgtaatcccagcactttgggaggccaaggcgggcggatcacgaggtcaggagatcgagaccatcctggctaacacggtgaaatcccggctctactaaaaatacaaaaagtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcacca

SEQ ID NO: 7739 - DNA, 1637 bp, synthetic construct
  misc_feature 1..1637: note = Synthetic polypeptide
  source 1..1637: mol_type = other DNA
tttcttggttccctgactgggaagcgaggtgattggtggatggtggaggcagctccttaggcagcttaagcctgtcctgtggaacatccctgtgggagactgtgaccagaccaagcgacacggatcctgagagcgctcccgggtaggcatttgccccggtgggacacctcaccacagcagtgtgtggcaggcccccgtggagaatcaacgcagtggctgaacaccgggaaggaatgggcacttggagtctggacatctaaaacttgtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaaatctataagtcgtaaggacttagtggattatataaccacacattataaggggccaagaatagtgcttgctgctgctggaggtgtttcccatgatgaattgcttgacttagcaaagtttcatttcggtgactctttatgcacacacaaaggagaaataccagctctgcctccctgcaaattcacaggaagtgagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggatgcgactctgtacaagtgtcacagaaagtgaggttgcacgagccagaaatcttctgaaaacaaacatgttgttgcagcttgatggttcaactccaatttgtgaagatattggtaggcaaatgttatgctataatagaaggattcccatccctgagcttgaagcaagaattgatgctgtgaatgctgagacaattcgagaagtatgtaccaaatacatttataataggagtccagctattgctgctgttggtcccattaagcaactaccagattttaaacagatacgcagtaacatgtgttggcttcgtgattaa

SEQ ID NO: 7740 - DNA, 1640 bp, synthetic construct
  misc_feature 1..1640: note = Synthetic polypeptide
  source 1..1640: mol_type = other DNA
tttcttggttccctgactgggaagcgaggtgattggtggatggtggaggcagctccttaggcagcttaagcctgtcctgtggaacatccctgtgggagactgtgaccagaccaagcgacacggatcctgagagcgctcccgggtaggcatttgccccggtgggacacctcaccacagcagtgtgtggcaggcccccgtggagaatcaacgcagtggctgaacaccgggaaggaatgggcacttggagtctggacatctaaaacttgtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaaatctataagtcgtaaggacttagtggattatataaccacacattataaggggccaagaatagtgcttgctgctgctggaggtgtttcccatgatgaattgcttgacttagcaaagtttcatttcggtgactctttatgcacacacaaaggagaaataccagctctgcctccctgcaaattcacaggaagtgagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggatgcgactctgtacaagtgtcacagaaagtgaggttgcacgagccagaaatcttctgaaaacaaacatgttgttgcagcttgatggttcaactccaatttgtgaagatattggtaggcaaatgttatgctataatagaaggattcccatccctgagcttgaagcaagaattgatgctgtgaatgctgagacaattcgagaagtatgtaccaaatacatttataataggagtccagctattgctgctgttggtaagcctggcttcttttcttctatgcaaaaagttggccaagtacttttaattaactcttctttttaa

SEQ ID NO: 7741 - DNA, 776 bp, synthetic construct
  misc_feature 1..776: note = Synthetic polypeptide
  source 1..776: mol_type = other DNA
tttcttggttccctgactgggaagcgaggtgattggtggatggtggaggcagctccttaggcagcttaagcctgtcctgtggaacatccctgtgggagactgtgaccagaccaagcgacacggatcctgagagcgctcccgggtaggcatttgccccggtgggacacctcaccacagcagtgtgtggcaggcccccgtggagaatcaacgcagtggctgaacaccgggaaggaatgggcacttggagtctggacatctaaaacttgtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagcttatcaaaatactgcacttggacggacaattttgggaccaactgaaaatatcaaatctataagtcgtaaggacttagtggattatataaccacacattataaggggccaagaatagtgcttgctgctgctggagattcgtgtgagggatga

SEQ ID NO: 7742 - DNA, 536 bp, synthetic construct
  misc_feature 1..536: note = Synthetic polypeptide
  source 1..536: mol_type = other DNA
tttcttggttccctgactgggaagcgaggtgattggtggatggtggaggcagctccttaggcagcttaagcctgtcctgtggaacatccctgtgggagactgtgaccagaccaagcgacacggatcctgagagcgctcccgggtaggcatttgccccggtgggacacctcaccacagcagtgtgtggcaggcccccgtggagaatcaacgcagtggctgaacaccgggaaggaatgggcacttggagtctggacatctaaaacttgtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaaggcaaggcaccaagaagagatcccagttagatctggaacttga

SEQ ID NO: 7743 - DNA, 527 bp, synthetic construct
  misc_feature 1..527: note = Synthetic polypeptide
  source 1..527: mol_type = other DNA
tttcttggttccctgactgggaagcgaggtgattggtggatggtggaggcagctccttaggcagcttaagcctgtcctgtggaacatccctgtgggagactgtgaccagaccaagcgacacggatcctgagagcgctcccgggtaggcatttgccccggtgggacacctcaccacagcagtgtgtggcaggcccccgtggagaatcaacgcagtggctgaacaccgggaaggaatgggcacttggagtctggacatctaaaacttgtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaaggcaaaagagatcccagttagatctggaacttga

SEQ ID NO: 7744 - DNA, 295 bp, synthetic construct
  misc_feature 1..295: note = Synthetic polypeptide
  source 1..295: mol_type = other DNA
gcatgggctttggaatcagagaagctggcttgaatttcaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctac

SEQ ID NO: 7745 - DNA, 286 bp, synthetic construct
  misc_feature 1..286: note = Synthetic polypeptide
  source 1..286: mol_type = other DNA
gcatgggctttggaatcagagaagctggcttgaatttcaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagt

SEQ ID NO: 7746 - DNA, 3541 bp, synthetic construct
  misc_feature 1..3541: note = Synthetic polypeptide
  source 1..3541: mol_type = other DNA
gcatgggctttggaatcagagaagctggcttgaatttcaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcagcttttgaaatcctgtcatgcagtgtcccaaacgcaaggcgaaggagatgcagcagatggtgaaattggaagccgagatggaccgcagaccagcaacagtagtatgaaactccaaaatgcaaactga

SEQ ID NO: 7747 - DNA, 3520 bp, synthetic construct
  misc_feature 1..3520: note = Synthetic polypeptide
  source 1..3520: mol_type = other DNA
gcatgggctttggaatcagagaagctggcttgaatttcaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaaggcttcagatgaccttgaacatgaaaacaacaaaaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcaggcgaaggagatgcagcagatggtgaaattggaagccgagatggaccgcagaccagcaacagtagtatga

SEQ ID NO: 7748 - DNA, 200 bp, synthetic construct
  misc_feature 1..200: note = Synthetic polypeptide
  source 1..200: mol_type = other DNA
gcatgggctttggaatcagagaagctggcttgaatttcaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctg

SEQ ID NO: 7749 - DNA, 135 bp, synthetic construct
  misc_feature 1..135: note = Synthetic polypeptide
  source 1..135: mol_type = other DNA
gcatgggctttggaatcagagaagctggcttgaatttcaggaatcctttgtgtttgaacccaactgcctcttcaaagtggatgagtttggcttctttctgacatggagaagtgaaggcaaggaaggacaggtgct

SEQ ID NO: 7750 - DNA, 3484 bp, synthetic construct
  misc_feature 1..3484: note = Synthetic polypeptide
  source 1..3484: mol_type = other DNA
gcatgggctttggaatcagagaagctggcttgaatttcaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcaggcgaaggagatgcagcagatggtgaaattggaagccgagatggaccgcagaccagcaacagtagtatga

SEQ ID NO: 7751 - DNA, 1392 bp, synthetic construct; identical to SEQ ID NO: 6782
  misc_feature 1..1392: note = Synthetic polypeptide
  source 1..1392: mol_type = other DNA

SEQ ID NO: 7752 - DNA, 933 bp, synthetic construct; identical to SEQ ID NO: 6783
  misc_feature 1..933: note = Synthetic polypeptide
  source 1..933: mol_type = other DNA

SEQ ID NO: 7753 - DNA, 981 bp, synthetic construct; identical to SEQ ID NO: 6784
  misc_feature 1..981: note = Synthetic polypeptide
  source 1..981: mol_type = other DNA

SEQ ID NO: 7754 - DNA, 1443 bp, synthetic construct; identical to SEQ ID NO: 6760
  misc_feature 1..1443: note = Synthetic polypeptide
  source 1..1443: mol_type = other DNA

SEQ ID NO: 7755 - DNA, 984 bp, synthetic construct; identical to SEQ ID NO: 6761
  misc_feature 1..984: note = Synthetic polypeptide
  source 1..984: mol_type = other DNA

SEQ ID NO: 7756 - DNA, 1032 bp, synthetic construct; identical to SEQ ID NO: 6762
  misc_feature 1..1032: note = Synthetic polypeptide
  source 1..1032: mol_type = other DNA

SEQ ID NO: 7757 - DNA, 311 bp, synthetic construct
  misc_feature 1..311: note = Synthetic polypeptide
  source 1..311: mol_type = other DNA
agaggtgattaggctatgagggctctgctttcatgaatggattaatgccattacggcagtgagttcattataaaaggacaagtttggcccccttctctctctttcttgctctcttttggcccttttgccttctgccatgggatgacacagcacaaaaaccctcaccagatgctgaccccttgatactggacttcccagcctccagaactataatgatggttgcagggcccctcttcaatggaggcattgccagccttctggccatgaaggagaaagtgatttcaactaacccaggaaactcttacctctaa

SEQ ID NO: 7758 - DNA, 1346 bp, synthetic construct
  misc_feature 1..1346: note = Synthetic polypeptide
  source 1..1346: mol_type = other DNA
ggacgggggcgcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaa

SEQ ID NO: 7759 - DNA, 696 bp, synthetic construct
  misc_feature 1..696: note = Synthetic polypeptide
  source 1..696: mol_type = other DNA
tggaagtgagtacctctatttttctagagatggtttaattatttccctctcttttctcatttttccggcaccccgtttcctacttagtccttcagaaatgtatatataacctttcacctcccccatcaccagacactccctaaggggcaagttcttctagataggtgctccatgacgggtctctcctcaagagttgacagttgatcagcagaccatagcatacctgccatggacctttcatctttaggggattgccttagaacttccatcctgggccacctcggaactcacacactttcggagggtgcgtcagaagcatatccagcggagccacccaagccctccatcaccagcaacaacttcaatccggtggagaacaaagatattgtggttttaacctgtcaacctgagactcagaacacaacctacctgtggtgggtaaacaatcagagcctcctggtcagtcccaggctgctgctctccactgacaacaggaccctcgttctactcagcgccacaaagaatgacataggaccctatgaatgtgaaatacagaacccagtgggtgccagccgcagtgacccagtcaccctgaatgtccgctatgagtcagtacaagcaagttcacctgacctctcagctgggaccgctgtcagcatcatgattggagtactggctgggatggctctgatatag

SEQ ID NO: 7760 - DNA, 1102 bp, synthetic construct
  misc_feature 1..1102: note = Synthetic polypeptide
  source 1..1102: mol_type = other DNA
tgatatggtttggctgtgtccccattcaaatctccacagagttgtatctcccagaattcccacatgttgtgggagggacccagggggaggtaattgaatcatggaggccggtctttcccatgctattctcgtgatagtgaataagtctcacgagatccgataggtttatcaggggtttccgcttttgcttcttccttattctttcttgctgccaccatgtaagaagtgccttttgctcttcgccatgattatgagacctccccagccatgtggaactatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatgagaaccactggatatctgtatattccggctttggcagcgttgcactctcccagttctctactctcccctcaggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactga

SEQ ID NO: 7761 - DNA, 1030 bp, synthetic construct
  misc_feature 1..1030: note = Synthetic polypeptide
  source 1..1030: mol_type = other DNA
tgatatggtttggctgtgtccccattcaaatctccacagagttgtatctcccagaattcccacatgttgtgggagggacccagggggaggtaattgaatcatggaggccggtctttcccatgctattctcgtgatagtgaataagtctcacgagatccgataggtttatcaggggtttccgcttttgcttcttccttattctttcttgctgccaccatgtaagaagtgccttttgctcttcgccatgattatgagacctccccagccatgtggaactatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactga

SEQ ID NO: 7762 - DNA, 898 bp, synthetic construct
  misc_feature 1..898: note = Synthetic polypeptide
  source 1..898: mol_type = other DNA
tgatatggtttggctgtgtccccattcaaatctccacagagttgtatctcccagaattcccacatgttgtgggagggacccagggggaggtaattgaatcatggaggccggtctttcccatgctattctcgtgatagtgaataagtctcacgagatccgataggtttatcaggggtttccgcttttgcttcttccttattctttcttgctgccaccatgtaagaagtgccttttgctcttcgccatgattatgagacctccccagccatgtggaactatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacagtgggggaaatag

SEQ ID NO: 7763 - DNA, 100 bp, synthetic construct; identical to SEQ ID NO: 6584
  misc_feature 1..100: note = Synthetic polypeptide
  source 1..100: mol_type = other DNA

SEQ ID NO: 7764 - DNA, 417 bp, synthetic construct
  misc_feature 1..417: note = Synthetic polypeptide
  source 1..417: mol_type = other DNA
tggaagtgagtacctctatttttctagagatggtttaattatttccctctcttttctcatttttccggcaccccgtttcctacttagtccttcagaaatgtatatataacctttcacctcccccatcaccagacactccctaaggggcaagttcttctagataggtgctccatgacgggtctctcctcaagagttgacagttgatcagcagaccatagcatacctgccatggacctttcatctttaggggattgccttagaacttccatcctgggccacctcggaactcacacactttcggagggtgcgtcagaagcatatccagatgagtcagtacaagcaagttcacctgacctctcagctgggaccgctgtcagcatcatgattggagtactggctgggatggctctgatatag

SEQ ID NO: 7765 - DNA, 1059 bp, synthetic construct
  misc_feature 1..1059: note = Synthetic polypeptide
  source 1..1059: mol_type = other DNA
tggaagtgagtacctctatttttctagagatggtttaattatttccctctcttttctcatttttccggcaccccgtttcctacttagtccttcagaaatgtatatataacctttcacctcccccatcaccagacactccctaaggggcaagttcttctagataggtgctccatgacgggtctctcctcaagagttgacagttgatcagcagaccatagcatacctgccatggacctttcatctttaggggattgccttagaacttccatcctgggccacctcggaactcacacactttcggagggtgcgtcagaagcatatccagcctcgcttttaaccttctggaacctgccaaacagtgcccagaccaatattgatgtcgtgccgttcaatgtcgcagaagggaaggaggtccttctagtagtccataatgagtcccagaatctttatggctacaactggtacaaaggggaaagggtgcatgccaactatcgaattataggatatgtaaaaaatataagtcaagaaaatgccccagggcccgcacacaacggtcgagagacaatataccccaatggaaccctgctgatccagaacgtcacccacaatgacgcaggattctataccctacacgttataaaagaaaatcttgtgaatgaagaagtaaccagacaattctacgtattctcggagccacccaagccctccatcaccagcaacaacttcaatccggtggagaacaaagatattgtggttttaacctgtcaacctgagactcagaacacaacctacctgtggtgggtaaacaatcagagcctcctggtcagtcccaggctgctgctctccactgacaacaggaccctcgttctactcagcgccacaaagaatgacataggaccctatgaatgtgaaatacagaacccagtgggtgccagccgcagtgacccagtcaccctgaatgtccgctatgagtcagtacaagcaagttcacctgacctctcagctgggaccgctgtcagcatcatgattggagtactggctgggatggctctgatatag

SEQ ID NO: 7766 - DNA, 780 bp, synthetic construct
  misc_feature 1..780: note = Synthetic polypeptide
  source 1..780: mol_type = other DNA
tggaagtgagtacctctatttttctagagatggtttaattatttccctctcttttctcatttttccggcaccccgtttcctacttagtccttcagaaatgtatatataacctttcacctcccccatcaccagacactccctaaggggcaagttcttctagataggtgctccatgacgggtctctcctcaagagttgacagttgatcagcagaccatagcatacctgccatggacctttcatctttaggggattgccttagaacttccatcctgggccacctcggaactcacacactttcggagggtgcgtcagaagcatatccagcctcgcttttaaccttctggaacctgccaaacagtgcccagaccaatattgatgtcgtgccgttcaatgtcgcagaagggaaggaggtccttctagtagtccataatgagtcccagaatctttatggctacaactggtacaaaggggaaagggtgcatgccaactatcgaattataggatatgtaaaaaatataagtcaagaaaatgccccagggcccgcacacaacggtcgagagacaatataccccaatggaaccctgctgatccagaacgtcacccacaatgacgcaggattctataccctacacgttataaaagaaaatcttgtgaatgaagaagtaaccagacaattctacgtattctatgagtcagtacaagcaagttcacctgacctctcagctgggaccgctgtcagcatcatgattggagtactggctgggatggctctgatatag

SEQ ID NO: 7767 - DNA, 164 bp, synthetic construct; identical to SEQ ID NO: 831
  misc_feature 1..164: note = Synthetic polypeptide
  source 1..164: mol_type = other DNA

SEQ ID NO: 7768 - DNA, 193 bp, synthetic construct; identical to SEQ ID NO: 834
  misc_feature 1..193: note = Synthetic polypeptide
  source 1..193: mol_type = other DNA

SEQ ID NO: 7769 - DNA, 732 bp, synthetic construct
  misc_feature 1..732: note = Synthetic polypeptide
  source 1..732: mol_type = other DNA
ggctggctgcagtggctcacacttttgatgccaccactttgggaggctgaggcctatgtgatccggggtgataccctgcggatggagctgccccagagggatgtgttctcgggcagtgacacagacccggacatggccttctgtaagagctttcgagacaagggcatcttcctccatctgagcaatcagcatgaatttggccggctcctggccacttccagatacgacacggagcacctgcaccccgacctctggcagatcttcgacaaccccgtcgactggaaggagcagtacatccacgagaactacagccgggccctggaaggggaaggaatcgtggagcagccatgcccggacgtgtactggttcccactgctgtcagaacaaatgtgtgatgagctggtggcagagatggagcactacggccagtggtcaggcggccggcatgaggcgcgggcggtgatgaactttgtggttcgctaccggccagacgagcagccgtctctgcggccacaccacgactcatccaccttcaccctcaacgttgccctcaaccacaagggcctggactatgagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctga

SEQ ID NO: 7770 - DNA, 879 bp, synthetic construct
  misc_feature 1..879: note = Synthetic polypeptide
  source 1..879: mol_type = other DNA
ggctggctgcagtggctcacacttttgatgccaccactttgggaggctgaggcctatgtgatccggggtgataccctgcggatggagctgccccagagggatgtgttctcgggcagtgacacagacccggacatggccttctgtaagagctttcgagacaagggcatcttcctccatctgagcaatcagcatgaatttggccggctcctggccacttccagatacgacacggagcacctgcaccccgacctctggcagatcttcgacaaccccgtcgactggaaggagcagtacatccacgagaactacagccgggccctggaaggggaaggaatcgtggagcagccatgcccggacgtgtactggttcccactgctgtcagaacaaatgtgtgatgagctggtggcagagatggagcactacggccagtggtcaggcggccggcatgaggattcaaggctggctggaggctacgagaatgtgcccaccgtggacatccacatgaagcaggtggggtacgaggaccagtggctgcagctgctgcggacgtatgtgggccccatgaccgagagcctgtttcccggttaccacaccaaggcgcgggcggtgatgaactttgtggttcgctaccggccagacgagcagccgtctctgcggccacaccacgactcatccaccttcaccctcaacgttgccctcaaccacaagggcctggactatgagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctga

SEQ ID NO: 7771 - DNA, 99 bp, synthetic construct
  misc_feature 1..99: note = Synthetic polypeptide
  source 1..99: mol_type = other DNA
ggctggctgcagtggctcacacttttgatgccaccactttgggaggctgaggcctatgtgatccggggtgataccctgcggatggagctgccccagagg

SEQ ID NO: 7772 - DNA, 646 bp, synthetic construct
  misc_feature 1..646: note = Synthetic polypeptide
  source 1..646: mol_type = other DNA
cagtgtggggcagtggttatgagcagggactctggagccagagtgcctgggttctcatcctgcttctgcagcgtggtagctggatggccttggacaagtcgcctgacctccccgtgcctcagcagtaaatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctgcagctttttggcactaaccgagaatga

SEQ ID NO: 7773 - DNA, 304 bp, synthetic construct
  misc_feature 1..304: note = Synthetic polypeptide
  source 1..304: mol_type = other DNA
cagtgtggggcagtggttatgagcagggactctggagccagagtgcctgggttctcatcctgcttctgcagcgtggtagctggatggccttggacaagtcgcctgacctccccgtgcctcagcagtaaatgctgtgttctttgcaacctacctgaccctggcttgctgttctggacccaggaggcatttcccctggaacctgattctcctgaccgtctttaccctgtccatggcctacctcactgggatgctgtccagttcgacttcacctcctgccagggcgtgctcttcgtgcttctcatga

SEQ ID NO: 7774 - DNA, 619 bp, synthetic construct
  misc_feature 1..619: note = Synthetic polypeptide
  source 1..619: mol_type = other DNA
cagtgtggggcagtggttatgagcagggactctggagccagagtgcctgggttctcatcctgcttctgcagcgtggtagctggatggccttggacaagtcgcctgacctccccgtgcctcagcagtaaatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctg

SEQ ID NO: 7775 - DNA, 523 bp, synthetic construct
  misc_feature 1..523: note = Synthetic polypeptide
  source 1..523: mol_type = other DNA
cagtgtggggcagtggttatgagcagggactctggagccagagtgcctgggttctcatcctgcttctgcagcgtggtagctggatggccttggacaagtcgcctgacctccccgtgcctcagcagtaaatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatttcctggcacttgacacccagttgctgatgggtaaccgacgccactcgctgagccctgaggagtatatttttggagccctc

SEQ ID NO: 7776 - DNA, 441 bp, synthetic construct
  misc_feature 1..441: note = Synthetic polypeptide
  source 1..441: mol_type = other DNA
cagtgtggggcagtggttatgagcagggactctggagccagagtgcctgggttctcatcctgcttctgcagcgtggtagctggatggccttggacaagtcgcctgacctccccgtgcctcagcagtaaatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaata

SEQ ID NO: 7777 - DNA, 167 bp, synthetic construct
  misc_feature 1..167: note = Synthetic polypeptide
  source 1..167: mol_type = other DNA
cagtgtggggcagtggttatgagcagggactctggagccagagtgcctgggttctcatcctgcttctgcagcgtggtagctggatggccttggacaagtcgcctgacctccccgtgcctcagcagtaaatgctgtgttctttgcaacctacctgaccctggcttgct

SEQ ID NO: 7778 - DNA, 1238 bp, synthetic construct
  misc_feature 1..1238: note = Synthetic polypeptide
  source 1..1238: mol_type = other DNA
agcagatactgttagtgccctacccagtcctcttgcttttaagtgcacacagactgacttctgacttctaactttgtacatctgtactttgcctgagggcttttctctctgtgacacccatagtagatttgaaatgcctggaattaatgctctttcttttcccccatccacttttctaagcaggcttcaagaaagaactcatcagagataatcatacggcagcttccccaccctttgggtgggttaacactctggtgcagtgtggtgactttcctcatctgttagtgtacggaccatcaggtgctggaaaaaagacaagaattatgtgtattctacgtgaactttatggtgttggagtggaaaaattgagaattgaacatcagaccatcacaactccatctaaaaaaaaaattgaaattagcaccattgcaagtaactaccaccttgaagttaatcctagtgatgctggaaatagtgaccgagtagtcattcaggagatgttgaaaacagtggcacaatcacaacaacttgaaacaaactctcaaagggattttaaagtggtattattgacagaagttgacaaactcaccaaagatgctcagcatgccttgcgaagaaccatggaaaaatatatgtctacctgcagattgatcttgtgctgcaattctacatctaaagtgatcccacctattcgtagtaggtgcttggcggttcgtgtgcctgctcccagcattgaagatatttgccacgtgttatctactgtgtgtaagaaggaaggtctgaatcttccttcacaactggctcatagacttgcagagaagtcttgtagaaatctcagaaaagccctgcttatgtgtgaagcctgcagagtgcaacaatatccttttactgcagatcaagaaatccctgagacagattgggaggtgtatctgagggagactgcaaatgctattgtcagtcagcaaactccacaaaggctccttgaagttcgtggaaggctgtatgagcttctaactcattgtattcctcctgagataataatgaagggccttctctcagaactgttacataattgtgatggacaactgaaaggggaggtggcacaaatggcagcttactatgagcatcgtctacagctgggtagcaaagccatttatcacttggaagcgtttgtggccaaattcatggcactttataagaagttcatggaggatggattggaaggcatgatgttctga

SEQ ID NO: 7779 - DNA, 1085 bp, synthetic construct
  misc_feature 1..1085: note = Synthetic polypeptide
  source 1..1085: mol_type = other DNA
agcagatactgttagtgccctacccagtcctcttgcttttaagtgcacacagactgacttctgacttctaactttgtacatctgtactttgcctgagggcttttctctctgtgacacccatagtagatttgaaatgcctggaattaatgctctttcttttcccccatccacttttctaagcaggcttcaagaaagaactcatcagagataatcatacggcagcttccccaccctttgggtgggttaacactctggtgcagtgtggtgactttcctcatctgttagtgtacggaccatcaggtgctggaaaaaagacaagaattatgtgtattctacgtgaactttatggtgttggagtggaaaaattgagaattgaacatcagaccatcacaactccatctaaaaaaaaaattgaaattagcaccattgcaagtaactaccaccttgaagttaatcctagtgatgctggaaatagtgaccgagtagtcattcaggagatgttgaaaacagtggcacaatcacaacaacttgaaacaaactctcaaagggattttaaagtggtattattgacagaagttgacaaactcaccaaagatgctcagcatgccttgcgaagaaccatggaaaaatatatgtctacctgcagattgatcttgtgctgcaattctacatctaaagtgatcccacctattcgtagtaggtgcttggcggttcgtgtgcctgctcccagcattgaagatatttgccacgtgttatctactgtgtgtaagaaggaaggtctgaatcttccttcacaactggctcatagacttgcagagaagtcttgtagaaatctcagaaaagccctgcttatgtgtgaagcctgcagagtgcaacaatatccttttactgcagatcaagaaatccctgagacagattgggaggtgtatctgagggagactgcaaatgctattgtcagtcagcaaactccacaaaggctccttgaagttcgtggaaggctgtatgagcttctaactcattgtattcctcctgagataataatgaaggcatgtaaggaggaatcaagaagctgtgacatattctga

SEQ ID NO: 7780 - DNA, 829 bp, synthetic construct; identical to SEQ ID NO: 624
  misc_feature 1..829: note = Synthetic polypeptide
  source 1..829: mol_type = other DNA

SEQ ID NO: 7781 - DNA, 2534 bp, synthetic construct; identical to SEQ ID NO: 586
  misc_feature 1..2534: note = Synthetic polypeptide
  source 1..2534: mol_type = other DNA

SEQ ID NO: 7782 - DNA, 145 bp, synthetic construct
  misc_feature 1..145: note = Synthetic polypeptide
  source 1..145: mol_type = other DNA
ggaaataggatgatcttttcagtttcaaactataagagaaacaatggatcagagcagaagcaatcatgtatacaggcagaatggagcccagtcccttccagctggctttattcagccccacgtgtccaagcattgtctgggatag

SEQ ID NO: 7783 - DNA, 846 bp, synthetic construct; identical to SEQ ID NO: 7174
  misc_feature 1..846: note = Synthetic polypeptide
  source 1..846: mol_type = other DNA

SEQ ID NO: 7784 - DNA, 506 bp, synthetic construct; identical to SEQ ID NO: 7175
  misc_feature 1..506: note = Synthetic polypeptide
  source 1..506: mol_type = other DNA

SEQ ID NO: 7785 - DNA, 672 bp, synthetic construct; identical to SEQ ID NO: 7176
  misc_feature 1..672: note = Synthetic polypeptide
  source 1..672: mol_type = other DNA

SEQ ID NO: 7786 - DNA, 708 bp, synthetic construct; identical to SEQ ID NO: 7177
  misc_feature 1..708: note = Synthetic polypeptide
  source 1..708: mol_type = other DNA

SEQ ID NO: 7787 - DNA, 561 bp, synthetic construct
  misc_feature 1..561: note = Synthetic polypeptide
  source 1..561: mol_type = other DNA
gccatgttgatttctcattagccccagtctcgtgaatgcctcctgattctgattttatttactgtttttagtgtaagaacaaagcagccttgatcttaccacacaaattataggcagtgacgcacatagcattcccacctgttctggaggatgcctttaattgcctctgtagagcacgtacaccctttccctgtggcatataagctctgggtctggccagtaacagagtgggttatacctgtcttgcagccatccgagatcacgcttctgtcttacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatga

SEQ ID NO: 7788 - DNA, 609 bp, synthetic construct
  misc_feature 1..609: note = Synthetic polypeptide
  source 1..609: mol_type = other DNA
gccatgttgatttctcattagccccagtctcgtgaatgcctcctgattctgattttatttactgtttttagtgtaagaacaaagcagccttgatcttaccacacaaattataggcagtgacgcacatagcattcccacctgttctggaggatgcctttaattgcctctgtagagcacgtacaccctttccctgtggcatataagctctgggtctggccagtaacagagtgggttatacctgtcttgcagccatccgagatcacgcttctgtcttacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggcaacctcgagtctgtctgtagagatctgcctattctggacatttcaggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatga

SEQ ID NO: 7789 - DNA, 720 bp, synthetic construct
  misc_feature 1..720: note = Synthetic polypeptide
  source 1..720: mol_type = other DNA
atccccaccagaggaaattccaaagagagtgtacttcagacaaaacagaaatgttctgaggcacaagaagaagtaaagagcaaaggaagtaatgcggccatcatggtctcttgctgtgctatttcttggtcaactgttgattatcaagtagctttaagaaaatccttgcctgacaaaaagcttcttaatggattatgtcccaaaatcacatatctcttttacaagttgtttacattattatcgtggatgctgagtgttgtacttctactattcttaaatgttaagattgctttatttctgttgttatttctttggttgttaggtataatatgggcatttaaaaacaacacccagttttgtacttgtataagtatggaattcttatataggattgttgttggattcattcttatctttacattttttaatattaagggacagaataccaagtgtccaatgtcttgttattatattgttagggtactgggcactttggggatattgactgtattctgggtttgccccctcactatttttaatccagactattttatacctatcagtataactatagttcttactcttcttcttggaattctttttcttattgtttattatgggagttttcacccaaacagaagtgcagaaacaaaatgtgatgaaattgatggaaaaccagttctaagagaatgtagaatgagatatttcctaatggaataa

SEQ ID NO: 7790 - DNA, 1490 bp, synthetic construct; identical to SEQ ID NO: 7414
  misc_feature 1..1490: note = Synthetic polypeptide
  source 1..1490: mol_type = other DNA

SEQ ID NO: 7791 - DNA, 1031 bp, synthetic construct; identical to SEQ ID NO: 7415
  misc_feature 1..1031: note = Synthetic polypeptide
  source 1..1031: mol_type = other DNA

SEQ ID NO: 7792 - DNA, 1079 bp, synthetic construct; identical to SEQ ID NO: 7416
  misc_feature 1..1079: note = Synthetic polypeptide
  source 1..1079: mol_type = other DNA

SEQ ID NO: 7793 - DNA, 1349 bp, synthetic construct; identical to SEQ ID NO: 7130
  misc_feature 1..1349: note = Synthetic polypeptide
  source 1..1349: mol_type = other DNA

SEQ ID NO: 7794 - DNA, 740 bp, synthetic construct
  misc_feature 1..740: note = Synthetic polypeptide
  source 1..740: mol_type = other DNA
gaccacttctcaattttcaattctgcttccaagaagtaaccatttttcaattctctgcaatttttatcaggtaaacttctttcttcatgcaccctgccaccctacatcagatccaacacagtagccagagtgatttttaaaatgaatttgatgaatcttcacccaaacaacctacaaatccttatgcatcatctaaagcagctgctgaatgttttgtacagtcttactgggaacaatataagtttccagttgtcatcacaagaagcagtaatgtttatggaccacatcaatatccagaaaaggttattccaaaatttatatctttgctacagcacaacaggaaatgttgcattcatgggtcagggcttcaaacaagaaacttcctttatgctactgatgttgtagaagcatttctcactgtcctcaaaaaagggaaaccaggtgaaatttataacatcggaaccaattttgaaatgtcagttgtccagcttgccaaagaactaatacaactgatcaaagagaccaattcagagtctgaaatggaaaattgggttgattatgttaatgatagacccaccaatgacatgagatacccaatgaagtcagaaaaaatacatggcttaggatggagacctaaagtgccttggaaagaaggaataaagaaaacaattgaatggtacagagagaattttcacaactggaagaatgtggaaaaggcattagaaccctttccggtataa

SEQ ID NO: 7795 - DNA, 411 bp, synthetic construct; identical to SEQ ID NO: 6630
  misc_feature 1..411: note = Synthetic polypeptide
  source 1..411: mol_type = other DNA

SEQ ID NO: 7796 - DNA, 1093 bp, synthetic construct
  misc_feature 1..1093: note = Synthetic polypeptide
  source 1..1093: mol_type = other DNA
gagtgtgggcgcgaggcagcagacggacgactcgcttattcacttctgctggaaggacaggacgtccgggaacgtggaagacgacttgatcatcttccctgacgactgtgagttcaagcgggtgccgcagtgccccagcgggagggtctacgtgctgaagttcaaggcagggtccaagcggcttttcttctggatgcaggaacccaagacagaccaggatgaggagcattgccggaaagtcaacgagtatctgaacaaccccccgatgcctggggcgctgggggccagcggaagcagcggccacgaactctctgcgctaggcggtgagggtggcctgcagagcctgctgggaaacatgagccacagccagctcatgcagctcatcggaccagccggccttggaggactgggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaagccatgcagaacaacgccaagcccgagcagaaagagggcgacacgaaggacaagaaggacgaagaggaggacatgagcctggactga

SEQ ID NO: 7797 - DNA, 427 bp, synthetic construct; identical to SEQ ID NO: 573
  misc_feature 1..427: note = Synthetic polypeptide
  source 1..427: mol_type = other DNA

SEQ ID NO: 7798 - DNA, 1327 bp, synthetic construct; identical to SEQ ID NO: 6801
  misc_feature 1..1327: note = Synthetic polypeptide
  source 1..1327: mol_type = other DNA

SEQ ID NO: 7799 - DNA, 812 bp, synthetic construct; identical to SEQ ID NO: 693
  misc_feature 1..812: note = Synthetic polypeptide
  source 1..812: mol_type = other DNA

SEQ ID NO: 7800 - DNA, 752 bp, synthetic construct; identical to SEQ ID NO: 694
  misc_feature 1..752: note = Synthetic polypeptide
  source 1..752: mol_type = other DNA

SEQ ID NO: 7801 - DNA, 2304 bp, synthetic construct
  misc_feature 1..2304: note = Synthetic polypeptide
  source 1..2304: mol_type = other DNA
tttccctgaggactcatattctcctttcctgcttcatttttctttacagaattattgacgtggcatgctgtaatgtttcagttttgtagttgtctatctccccacagtggaatatgagttctgtgaaagcaaggatttttgtctcctttgttcaaagctgtatccctgagaatggcacctaagtatacttactccttgggcatgtcccacccgctgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccagatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtga

SEQ ID NO: 7802 - DNA, 1224 bp, synthetic construct; identical to SEQ ID NO: 6690
  misc_feature 1..1224: note = Synthetic polypeptide
  source 1..1224: mol_type = other DNA

SEQ ID NO: 7803 - DNA, 842 bp, synthetic construct; identical to SEQ ID NO: 6534
  misc_feature 1..842: note = Synthetic polypeptide
  source 1..842: mol_type = other DNA

SEQ ID NO: 7804 - DNA, 395 bp, synthetic construct
  misc_feature 1..395: note = Synthetic polypeptide
  source 1..395: mol_type = other DNA
atgcagcaaaaaacagcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctga

SEQ ID NO: 7805 - DNA, 173 bp, synthetic construct
  misc_feature 1..173: note = Synthetic polypeptide
  source 1..173: mol_type = other DNA
atgcagcaaaaaacagcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggtaccgctgcagctag

SEQ ID NO: 7806 - DNA, 585 bp, synthetic construct
  misc_feature 1..585: note = Synthetic polypeptide
  source 1..585: mol_type = other DNA
gatcattttttaggctgtttcacaaggcattcctgcatcagtggcagatacaagcagaagaaggagttggagcataggttgtctgcaatgaaatctgctgtggaaagtggtcaagcagatgatgagcgtgttcgtgaatattatcttcttcaccttcagaggtggattgatatcagcttagaagagattgagagcattgaccaggaaataaagatcctgagagaaagagactcttcaagagaggcatcaacttctaactcatctcgccaggagaggcctccagtgaaacccttcattctcactcggaacatggctcaagccaaagtatttggagctggttatccaagtctgccaactatgacggtgagtgactggtatgagcaacatcggaaatatggagcattaccggatcagggaatagccaaggcagcaccagaggaattcagaaaagcagctcagcaacaggaagaacaagaagaaaaggaggaagaggatgatgaacaaacactccacagagcccgggagtgggatgactggaaggacacccatcctaggggctatgggaaccgacagaacatgggctga

SEQ ID NO: 7807 - DNA, 425 bp, synthetic construct
  misc_feature 1..425: note = Synthetic polypeptide
  source 1..425: mol_type = other DNA
tgctgtggtttgaatgtgttccctaaagcttattggaaacttaatccccactgcaacagcactgagaagtgggagctttaacagctgagctgattaggtcttgagggctccattccttgttactgggttaatgtcattataatgggagtaagttaatcagccagggagtgagttcctgataaaaagatgagttccccaattcccctcttctcttctgcaacagacatgctctcttgaccttctgccttctcccatgggatgactcagcaagaagacccttgttaaatgtgtgcccctcagccttggacttagcctgcagaactataatgatggttgcagggcccctcttcaatggaggcattgccagccttctggccatgaaggagaaagtgatttcaactaacccaggaaactcttacctctaa

SEQ ID NO: 7808 - DNA, 1219 bp, synthetic construct
  misc_feature 1..1219: note = Synthetic polypeptide
  source 1..1219: mol_type = other DNA
aagtacagggaatgtagtagtatccttggggagctctcaggcagtgaggaatgagagtccatttctaaaccctccctctatctagaagaggctgttccaaggtgggctccacacactccctccagggccccagtgcgactgagccccagttgtccctggatgtaacctgcccttttccttttctcttatgggattttcctgttctctctccctgctccctcatttctgcttcctaggatctcctcccaaacgaacctcagacatccaggacatcaccagcttgctgcacaccatctatgaggtggtggactcctctgtcaaccactccccaacatccagcaagatgctgcgggtaaagctcaccgtggcccccgatggcagccagagcaagaggagcgtccttgtcaatcaggctgacctgcagagcgcaaggccccgagcagagaccaagcccactgaggacctgcggagctgggagaagaagcagcgagccccgctcaggttccagggtgacagccgcctggagcagtctggctgctaccaccattgcgtagatgagaacatcgagaggagaaaccactacttagatctcgccgggatagaaaactacacgtcccaatttgggcctggctccccttccgtggcccagaagtcagaactgcccccccgcacctccaatcccactcgatctcgctcccatgagccggaagccatccacatcccacaccgaaagccccaaggcgtggacccggcctccttccacttccttgacaccccaatcgccaaggtctcagagctccagcaacggctccggggcacccaggacgggagcaagcactttgtgaggtcccccaaggcccagggcaagagtgtgggtgtgggccacgtggccagaggggcaagaaacaagccccctctgggacccgccatccctgcggtgtccccctccgcccacctggctgccagcccggccctcctcccctccctagcccccctcgggcacaagaagcacaagcaccgagccaaggagagccagcagggctgccggggcctgcaggcaccactggcctcaggtggccctgtcctggggcgggagcacctgcgggagctgcccgccttggtggtgtatgagagccaggccgggcagccggtccagagacatgagcaccaccaccaccatgaacatcaccaccattaccaccacttctaccagacatag

SEQ ID NO: 7809 - DNA, 2000 bp, synthetic construct
  misc_feature 1..2000: note = Synthetic polypeptide
  source 1..2000: mol_type = other DNA
tggggcctgtccacactgccgtggtcttatcttgtgactctggcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctga

SEQ ID NO: 7810 - DNA, 1157 bp, synthetic construct
  misc_feature 1..1157: note = Synthetic polypeptide
  source 1..1157: mol_type = other DNA
tggggcctgtccacactgccgtggtcttatcttgtgactctggcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggctcgcgctgcctgtgtggtgtcgcgccttctcccccccggggctgggttggcgcaccctcccctcccgtctactcattccccggggcgtttctttgccgatttttgaatgtgattttaaagagtgaaaaatga

SEQ ID NO: 7811 - DNA, 1084 bp, synthetic construct; identical to SEQ ID NO: 580
  misc_feature 1..1084: note = Synthetic polypeptide
  source 1..1084: mol_type = other DNA

SEQ ID NO: 7812 - DNA, 2725 bp, synthetic construct; identical to SEQ ID NO: 6753
  misc_feature 1..2725: note = Synthetic polypeptide
  source 1..2725: mol_type = other DNA

SEQ ID NO: 7813 - DNA, 524 bp, synthetic construct
  misc_feature 1..524: note = Synthetic polypeptide
  source 1..524: mol_type = other DNA
gtccccagcaggctttgtggccctgggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgacccctacgccacctttgtcaagatgctgccagataaggactgccgctatgccctctatgatgcaacctatgagaccaaggagagcaagaaggaggatctggtgtttatcttctgggcccccgagtctgcgccccttaagagcaaaatgatttatgccagctccaaggacgccatcaagaagaagctgacagggatcaagcatgaattgcaagcaaactgctacgaggaggtcaaggaccgctgcaccctggcagagaagctggggggcagtgccgtcatctccctggagggcaagcctttgtga

SEQ ID NO: 7814 - DNA, 502 bp, synthetic construct
  misc_feature 1..502: note = Synthetic polypeptide
  source 1..502: mol_type = other DNA
gtccccagcaggctttgtggccctgggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgacccctacgccacctttgtcaagatgctgccagataaggactgccgctatgccctctatgatgcaacctatgagaccaaggagagcaagaaggaggatctggtgtttatcttctgggcccccgagtctgcgccccttaagagcaaaatgatttatgccagctccaaggacgccatcaagaagaagctgacagggatcaagcatgaattgcaagcaaactgctacgaggaggtcaaggaccgctgcaccctggcagagaagctggggggcagtgccgtcatctc

SEQ ID NO: 7815 - DNA, 295 bp, synthetic construct
  misc_feature 1..295: note = Synthetic polypeptide
  source 1..295: mol_type = other DNA
gtccccagcaggctttgtggccctgggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgacccctacgccacctttgtcaagatgctgccagataaggactgccgctatgccctctatgatgcaacctatgagac

SEQ ID NO: 7816 - DNA, 701 bp, synthetic construct; identical to SEQ ID NO: 658
  misc_feature 1..701: note = Synthetic polypeptide
  source 1..701: mol_type = other DNA

SEQ ID NO: 7817 - DNA, 961 bp, synthetic construct; identical to SEQ ID NO: 6722
  misc_feature 1..961: note = Synthetic polypeptide
  source 1..961: mol_type = other DNA

SEQ ID NO: 7818 - DNA, 80 bp, synthetic construct; identical to SEQ ID NO: 6364
  misc_feature 1..80: note = Synthetic polypeptide
  source 1..80: mol_type = other DNA

SEQ ID NO: 7819 - DNA, 217 bp, synthetic construct; identical to SEQ ID NO: 6365
  misc_feature 1..217: note = Synthetic polypeptide
  source 1..217: mol_type = other DNA

SEQ ID NO: 7820 - DNA, 242 bp, synthetic construct
  misc_feature 1..242: note = Synthetic polypeptide
  source 1..242: mol_type = other DNA
cagtggaaagagtgtggcactggagatttgcatattttcaaattccagctcaggcccttgcctgttcgcctttctgagcctcatttttttcttctgtgaaatggccatgctagtgcctgccaggcagggtgatgtcagagttggagacggcgtgtggaaagcccatgaggcacaaaacctcctccagctcgcttaggatgggggcctatgtcttcatcggcgtgggggcagtcactatgctc

SEQ ID NO: 7821 - DNA, 398 bp, synthetic construct
  misc_feature 1..398: note = Synthetic polypeptide
  source 1..398: mol_type = other DNA
cagtggaaagagtgtggcactggagatttgcatattttcaaattccagctcaggcccttgcctgttcgcctttctgagcctcatttttttcttctgtgaaatggccatgctagtgcctgccaggcagggtgatgtcagagttggagacggcgtgtggaaagcccatgaggcacaaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaagctgaagcaggagatgggcggcatc

SEQ ID NO: 7822 - DNA, 842 bp, synthetic construct
  misc_feature 1..842: note = Synthetic polypeptide
  source 1..842: mol_type = other DNA
cagtggaaagagtgtggcactggagatttgcatattttcaaattccagctcaggcccttgcctgttcgcctttctgagcctcatttttttcttctgtgaaatggccatgctagtgcctgccaggcagggtgatgtcagagttggagacggcgtgtggaaagcccatgaggcacaaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaagctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcgaagtcaagggggaagaggacaacagcctttctgtgaggaagggcttctgcgaggcccccggcaacaggacccagagtggcaaccaccctgaggactggcctgtgtaccaggagggctgcatggagaaggtgcaggcgtggctgcaggagaacctgggcatcatcctcggcgtgggcgtgggtgtggccatcatcgagctcctggggatggtcctgtccatctgcttgtgccggcacgtccattccgaagactacagcaaggtccccaagtactga

SEQ ID NO: 7823 - DNA, 767 bp, synthetic construct
  misc_feature 1..767: note = Synthetic polypeptide
  source 1..767: mol_type = other DNA
cagtggaaagagtgtggcactggagatttgcatattttcaaattccagctcaggcccttgcctgttcgcctttctgagcctcatttttttcttctgtgaaatggccatgctagtgcctgccaggcagggtgatgtcagagttggagacggcgtgtggaaagcccatgaggcacaaaacctcctccagctcgcttaggatgggggcctatgtcttcatcggcgtgggggcagtcactatgctcatgggcttcctgggctgcatcggcgccgtcaacgaggtccgctgcctgctggggctgctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcgaagtcaagggggaagaggacaacagcctttctgtgaggaagggcttctgcgaggcccccggcaacaggacccagagtggcaaccaccctgaggactggcctgtgtaccaggagggctgcatggagaaggtgcaggcgtggctgcaggagaacctgggcatcatcctcggcgtgggcgtgggtgtggccatcatcgagctcctggggatggtcctgtccatctgcttgtgccggcacgtccattccgaagactacagcaaggtccccaagtactga

SEQ ID NO: 7824 - DNA, 362 bp, synthetic construct
  misc_feature 1..362: note = Synthetic polypeptide
  source 1..362: mol_type = other DNA
cagtggaaagagtgtggcactggagatttgcatattttcaaattccagctcaggcccttgcctgttcgcctttctgagcctcatttttttcttctgtgaaatggccatgctagtgcctgccaggcagggtgatgtcagagttggagacggcgtgtggaaagcccatgaggcacaaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttc

SEQ ID NO: 7825 - DNA, 383 bp, synthetic construct
  misc_feature 1..383: note = Synthetic polypeptide
  source 1..383: mol_type = other DNA
cagtggaaagagtgtggcactggagatttgcatattttcaaattccagctcaggcccttgcctgttcgcctttctgagcctcatttttttcttctgtgaaatggccatgctagtgcctgccaggcagggtgatgtcagagttggagacggcgtgtggaaagcccatgaggcacaaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaaggtaagcccc

SEQ ID NO: 7826 - DNA, 352 bp, synthetic construct
  misc_feature 1..352: note = Synthetic polypeptide
  source 1..352: mol_type = other DNA
cagtggaaagagtgtggcactggagatttgcatattttcaaattccagctcaggcccttgcctgttcgcctttctgagcctcatttttttcttctgtgaaatggccatgctagtgcctgccaggcagggtgatgtcagagttggagacggcgtgtggaaagcccatgaggcacaaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccct

SEQ ID NO: 7827 - DNA, 568 bp, synthetic construct
  misc_feature 1..568: note = Synthetic polypeptide
  source 1..568: mol_type = other DNA
cagtggaaagagtgtggcactggagatttgcatattttcaaattccagctcaggcccttgcctgttcgcctttctgagcctcatttttttcttctgtgaaatggccatgctagtgcctgccaggcagggtgatgtcagagttggagacggcgtgtggaaagcccatgaggcacaaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaagctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcga

SEQ ID NO: 7828 - DNA, 171 bp, synthetic construct; identical to SEQ ID NO: 6873
  misc_feature 1..171: note = Synthetic polypeptide
  source 1..171: mol_type = other DNA

SEQ ID NO: 7829 - DNA, 633 bp, synthetic construct; identical to SEQ ID NO: 6874
  misc_feature 1..633: note = Synthetic polypeptide
  source 1..633: mol_type = other DNA

SEQ ID NO: 7830 - DNA, 636 bp, synthetic construct; identical to SEQ ID NO: 6875
  misc_feature 1..636: note = Synthetic polypeptide
  source 1..636: mol_type = other DNA

SEQ ID NO: 7831 - DNA, 480 bp, synthetic construct; identical to SEQ ID NO: 6876
  misc_feature 1..480: note = Synthetic polypeptide
  source 1..480: mol_type = other DNA

SEQ ID NO: 7832 - DNA, 695 bp, synthetic construct
  misc_feature 1..695: note = Synthetic polypeptide
  source 1..695: mol_type = other DNA
cccaagggagtgactagccactgggtgacactggtacagtagctccagaaaaatgcttatttggggcaatgctaaatattgcggcagttttatgcattgctaccatttatgttcgttataagcaagttcatgctctgagtcctgaagagaacgttatcatcaaattaaacaaggctggccttgtacttggaatactgagttgtttaggactttctattgtggcaaacttccagaaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaaggttatgtgcttcacatgatcactactgcagcagaatggtctatgtcattttccttctttggttttttcctgacttacattcgtgattttcagaaaatttctttacgggtggaagccaatttacatggattaaccctctatgacactgcaccttgccctattaacaatgaacgaacacggctactttccagagatatttga

SEQ ID NO: 7833 - DNA, 95 bp, synthetic construct
  misc_feature 1..95: note = Synthetic polypeptide
  source 1..95: mol_type = other DNA
cccaagggagtgactagccactgggtgacactggtacagtagctccagaaaaatgcttatttggggcaatgctaaatattgcggcagttttatag

SEQ ID NO: 7834 - DNA, 601 bp, synthetic construct
  misc_feature 1..601: note = Synthetic polypeptide
  source 1..601: mol_type = other DNA
gtgtttattagagcaggctgtgaggttgtggactccatctggattaggatccttgccccgctgtttgttaactgtgtgatcttgagcaggttaccccacctctctgagcctccgtgtcctcatctgtacaacgtggaggatacgggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagaggccttcgtcaagatggttggacaccacgtcgccttcctggaagcagacgtgcttcaggctgagcgggaccatggggccttccctcaggccctgcggaggtggctgggatccgcagggctcccctccttcaggaacgtggagtgcagtggcacaatcccagctcgctgcaacctccgcctcccgggttcaagtgattctcctgcctccgcctcccaagtagctgggattacagaagtcacctgcaccggtgcccgtgacgtacgagctgcccacactgtatag

SEQ ID NO: 7835 - DNA, 442 bp, synthetic construct
  misc_feature 1..442: note = Synthetic polypeptide
  source 1..442: mol_type = other DNA
gtgtttattagagcaggctgtgaggttgtggactccatctggattaggatccttgccccgctgtttgttaactgtgtgatcttgagcaggttaccccacctctctgagcctccgtgtcctcatctgtacaacgtggaggatacgggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagagaagtcacctgcaccggtgcccgtgacgtacgagctgcccacactgtataggacggaggactattttcctgtggacgccggggaagcacagcaccacccccgcacctgccctcggcctttgtga

SEQ ID NO: 7836 - DNA, 577 bp, synthetic construct
  misc_feature 1..577: note = Synthetic polypeptide
  source 1..577: mol_type = other DNA
gtgtttattagagcaggctgtgaggttgtggactccatctggattaggatccttgccccgctgtttgttaactgtgtgatcttgagcaggttaccccacctctctgagcctccgtgtcctcatctgtacaacgtggaggatacgggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagaggccttcgtcaagatggttggacaccacgtcgccttcctggaagcagacgtgcttcaggctgagcgggaccatggggccttccctcaggccctgcggaggtggctgggatccgcagggctcccctccttcaggaacaagtcacctgcaccggtgcccgtgacgtacgagctgcccacactgtataggacggaggactattttcctgtggacgccggggaagcacagcaccacccccgcacctgccctcggcctttgtga

SEQ ID NO: 7837 - DNA, 406 bp, synthetic construct
  misc_feature 1..406: note = Synthetic polypeptide
  source 1..406: mol_type = other DNA
gtgtttattagagcaggctgtgaggttgtggactccatctggattaggatccttgccccgctgtttgttaactgtgtgatcttgagcaggttaccccacctctctgagcctccgtgtcctcatctgtacaacgtggaggatacgggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagagaagtcacctgcaccggtgcccgtgacgtacgagctgcccacactgtataggacggaggactattttcctgtggacgccggggaagca

SEQ ID NO: 7838 - DNA, 325 bp, synthetic construct
  misc_feature 1..325: note = Synthetic polypeptide
  source 1..325: mol_type = other DNA
gtgtttattagagcaggctgtgaggttgtggactccatctggattaggatccttgccccgctgtttgttaactgtgtgatcttgagcaggttaccccacctctctgagcctccgtgtcctcatctgtacaacgtggaggatacgggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagagagttaa

SEQ ID NO: 7839 - DNA, 337 bp, synthetic construct; identical to SEQ ID NO: 6393
  misc_feature 1..337: note = Synthetic polypeptide
  source 1..337: mol_type = other DNA

SEQ ID NO: 7840 - DNA, 583 bp, synthetic construct
  misc_feature 1..583: note = Synthetic polypeptide
  source 1..583: mol_type = other DNA
tgaatattacattacatgacaaaagggactttgcagatatacttaagattactaatcagttcaccttaaaatagaaaggtcatcctggactatctgggtgggcccagaataatcacacaaacccttaaaagcagagtttcctcctgactgagggcagaagaggaagtcagagagatttctaagcatgacacagcattggtggctcaaagatgggggccgtggaaaatgtgagaagaaatgaattcaaccaacagtgagccccagggtgtttttcctgaatgtgccatttgattccatcatggagcggctgactctgagaagaattgatccagtcactggggaaaggtaccacctcatgtacaagccacctcccaccatggagatccaggctcgcctcctgcagaacccaaaggatgctgaagagcaggtcaagctgaaaatggacctgttctacaggaactcagctgacttggagcagttgtatgggtcggccatcaccctcaatggggaccaggacccatacacagtcttcgaatacatcgagagtgggatcattaatcccctgcccaagaaaatcccctga

SEQ ID NO: 7841 - DNA, 414 bp, synthetic construct; identical to SEQ ID NO: 6481
  misc_feature 1..414: note = Synthetic polypeptide
  source 1..414: mol_type = other DNA

SEQ ID NO: 7842 - DNA, 495 bp, synthetic construct
  misc_feature 1..495: note = Synthetic polypeptide
  source 1..495: mol_type = other DNA
tgctgtggtttgaatgagtctcgcaaagttggtatattggaaccttaaccccccatgcagtgctgagaggtcaaacctttgagaggtgactaggtcatgagggctctgtcctcgtaaatggattaatgtcactattgtgggagaggattcgttatctcaagtgagcttgttataaaaccaagtttggctgtgtcttgctttcttgccctctcacgctgtcttccccctccatcttccgccatgggatgatgctacaaggaggccctcaccagatgcaggcttttgaccttggatttgccagcctccagaattgctttctccaccaccacaacagcatgtggtctgacagaattggcttcaaagaagaaactaaaagccacctcttgcaggaaactgcactgccctcaacatccagcccctactccttggtcctccaaacccccaaactctgcaggagaaaggcagcatggtacatggggaggaagaccagactga

SEQ ID NO: 7843 - DNA, 373 bp, synthetic construct
  misc_feature 1..373: note = Synthetic polypeptide
  source 1..373: mol_type = other DNA
tgctgtggtttgaatgagtctcgcaaagttggtatattggaaccttaaccccccatgcagtgctgagaggtcaaacctttgagaggtgactaggtcatgagggctctgtcctcgtaaatggattaatgtcactattgtgggagaggattcgttatctcaagtgagcttgttataaaaccaagtttggctgtgtcttgctttcttgccctctcacgctgtcttccccctccatcttccgccatgggatgatgctacaaggaggccctcaccagatgcaggcttttgaccttggatttgccagcctccagaattgctttctccaccaccacaacagcatgtggtctgacagaattggcttcaaagaagaaactaa

SEQ ID NO: 7844 - DNA, 1960 bp, synthetic construct
  misc_feature 1..1960: note = Synthetic polypeptide
  source 1..1960: mol_type = other DNA
cccctctgatgggacaattctgagataaaagtccaacctgatcgtggtccagagaggtcacagcccacccacatcatccttggttcagccccaatcccaataccagctgagtcagatgacatttcacaagatccctgctgacagcctggagtggcatgagaacctgggccatgggtccttcaccaagatttaccggggctgtcgccatgaggtggtggatggggaggcccgaaagacagaggtgctgctgaaggtcatggatgccaagcacaagaactgcatggagtcattcctggaagcagcgagcttgatgagccaagtgtcgtaccggcatctcgtgctgctccacggcgtgtgcatggctggagacagcaccatggtgcaggaatttgtacacctgggggccatagacatgtatctgcgaaaacgtggccacctggtgccagccagctggaagctgcaggtggtcaaacagctggcctacgccctcaactatctggaggacaaaggcctgccccatggcaatgtctctgcccggaaggtgctcctggctcgggagggggctgatgggagcccgcccttcatcaagctgagtgaccctggggtcagccccgctgtgttaagcctggagatgctcaccgacaggatcccctgggtggcccccgagtgtctccgggaggcgcagacacttagcttggaagctgacaagtggggcttcggcgccacggtctgggaagtgtttagtggcgtcaccatgcccatcagtgccctggatcctgctaagaaactccaattttatgaggaccggcagcagctgccggcccccaagtggacagagctggccctgctgattcaacagtgcatggcctatgagccggtccagaggccctccttccgagccgtcattcgtgacctcaatagcctcatctcttcagactatgagctcctctcagaccccacacctggtgccctggcacctcgtgatgggctgtggaatggtgcccagctctatgcctgccaagaccccacgatcttcgaggagagacacctcaagtacatctcacagctgggcaagggcaactttggcagcgtggagctgtgccgctatgacccgctaggcgacaatacaggtgccctggtggccgtgaaacagctgcagcacagcgggccagaccagcagagggactttcagcgggagattcagatcctcaaagcactgcacagtgatttcattgtcaagtatcgtggtgtcagctatggcccgggccgccagagcctgcggctggtcatggagtacctgcccagcggctgcttgcgcgacttcctgcagcggcaccgcgcgcgcctcgatgccagccgcctccttctctattcctcgcagatctgcaagggcatggagtacctgggctcccgccgctgcgtgcaccgcgacctggccgcccgaaacatcctcgtggagagcgaggcacacgtcaagatcgctgacttcggcctagctaagctgctgccgcttgacaaagactactacgtggtccgcgagccaggccagagccccattttctggtatgcccccgaatccctctcggacaacatcttctctcgccagtcagacgtctggagcttcggggtcgtcctgtacgagctcttcacctactgcgacaaaagctgcagcccctcggccgagttcctgcggatgatgggatgtgagcgggatgtccccgccctctgccgcctcttggaactgctggaggagggccagaggctgccggcgcctcctgcctgccctgctgaggttcacgagctcatgaagctgtgctgggcccctagcccacaggaccggccatcattcagcgccctgggcccccagctggacatgctgtggagcggaagccgggggtgtgagactcatgccttcactgctcacccagagggcaaacaccactccctgtccttttcatag

SEQ ID NO: 7845 - DNA, 1870 bp, synthetic construct
  misc_feature 1..1870: note = Synthetic polypeptide
  source 1..1870: mol_type = other DNA
cccctctgatgggacaattctgagataaaagtccaacctgatcgtggtccagagaggtcacagcccacccacatcatccttggttcagccccaatcccaataccagctgagtcagatgacatttcacaagatccctgctgacagcctggagtggcatgagaacctgggccatgggtccttcaccaagatttaccggggctgtcgccatgaggtggtggatggggaggcccgaaagacagaggtgctgctgaaggtcatggatgccaagcacaagaactgcatggagtcattcctggaagcagcgagcttgatgagccaagtgtcgtaccggcatctcgtgctgctccacggcgtgtgcatggctggagacagcaccatggtgcaggaatttgtacacctgggggccatagacatgtatctgcgaaaacgtggccacctggtgccagccagctggaagctgcaggtggtcaaacagctggcctacgccctcaactatctggaggacaaaggcctgccccatggcaatgtctctgcccggaaggtgctcctggctcgggagggggctgatgggagcccgcccttcatcaagctgagtgaccctggggtcagccccgctgtgttaagcctggagatgctcaccgacaggatcccctgggtggcccccgagtgtctccgggaggcgcagacacttagcttggaagctgacaagtggggcttcggcgccacggtctgggaagtgtttagtggcgtcaccatgcccatcagtgccctggatcctgctaagaaactccaattttatgaggaccggcagcagctgccggcccccaagtggacagagctggccctgctgattcaacagtgcatggcctatgagccggtccagaggccctccttccgagccgtcattcgtgacctcaatagcctcatctcttcagactatgagctcctctcagaccccacacctggtgccctggcacctcgtgatgggctgtggaatggtgcccagctctatgcctgccaagaccccacgatcttcgaggagagacacctcaagtacatctcacagctgggcaagggcaactttggcagcgtggagctgtgccgctatgacccgctaggcgacaatacaggtgccctggtggccgtgaaacagctgcagcacagcgggccagaccagcagagggactttcagcgggagattcagatcctcaaagcactgcacagtgatttcattgtcaagtatcgtggtgtcagctatggcccgggccgccagagcctgcggctggtcatggagtacctgcccagcggctgcttgcgcgacttcctgcagcggcaccgcgcgcgcctcgatgccagccgcctccttctctattcctcgcagatctgcaagggcatggagtacctgggctcccgccgctgcgtgcaccgcgacctggccgcccgaaacatcctcgtggagagcgaggcacacgtcaagatcgctgacttcggcctagctaagctgctgccgcttgacaaagactactacgtggtccgcgagccaggccagagccccattttctggtatgcccccgaatccctctcggacaacatcttctctcgccagtcagacgtctggagcttcggggtcgtcctgtacgagctcttcacctactgcgacaaaagctgcagcccctcggccgagttcctgcggatgatgggatgtgagcgggatgtccccgccctctgccgcctcttggaactgctggaggagggccagaggctgccggcgcctcctgcctgccctgctgaggtgagcgccgcagggctagcctcagtttcccagtctgtagattgggccggggtctcgggcaagccagctggcgcctga

SEQ ID NO: 7846 - DNA, 664 bp, synthetic construct
  misc_feature 1..664: note = Synthetic polypeptide
  source 1..664: mol_type = other DNA
ccaagagtagaacaaagatggaggactaggtcataaaagacactgcaactcctctctctctctctctctctctctctctctctctctgtctctctctctttctttatttctctctcttgttgttcactctccagggagccagttgccatgtcatggggaggacactcaggcagccccgtggggagactcatgtgaggaggaactgagatgtcttgccaacatccatatgagggagccatcttgtaaatgaatcttccagtcccaatcaagtcttcagatgaccagagcctcagctgataacttggctgcagcctcatgagagatcctgagccagaaccactcagccaaggactcatctgatgatgtgagaagagttcagaggagggagaaaaatcgtattgccgcccagaagagccgacagaggcagacacagaaggccgacaccctgcacctggagagcgaagacctggagaaacagaacgcggctctacgcaaggagatcaagcagctcacagaggaactgaagtacttcacgtcggtgctgaacagccacgagcccctgtgctcggtgctggccgccagcacgccctcgccccccgaggtggtgtacagcgcccacgcattccaccaacctcatgtcagctccccgcgcttccagccctga

SEQ ID NO: 7847 - DNA, 508 bp, synthetic construct
  misc_feature 1..508: note = Synthetic polypeptide
  source 1..508: mol_type = other DNA
ccaagagtagaacaaagatggaggactaggtcataaaagacactgcaactcctctctctctctctctctctctctctctctctctctgtctctctctctttctttatttctctctcttgttgttcactctccagggagccagttgccatgtcatggggaggacactcaggcagccccgtggggagactcatgtgaggaggaactgagatgtcttgccaacatccatatgagggagccatcttgtaaatgaatcttccagtcccaatcaagtcttcagatgaccagagcctcagctgataacttggctgcagcctcatgagagatcctgagccagaaccactcagccaaggactcatctgatgatgtgagaagagttcagaggagggagaaaaatcgtattgccgcccagaagagccgacagaggcagacacagaagagtattaagaaagatgctcaagtcccatggcacagagcaaggcgggcagggaacggttatttttctaaataa

SEQ ID NO: 7848 - DNA, 2360 bp, synthetic construct
  misc_feature 1..2360: note = Synthetic polypeptide
  source 1..2360: mol_type = other DNA
tgatacggtttggctgtgtccccacccaaatctcaacttgaattgtatctcccagaattcccacatgttgcaggagggatccagggggaggtaattgaatcacccacatgtagcgggagggacccagggggaggtaattgaatcatgggggtcggtctttcctgtgctgttcttgtcacagtaagtctcacgaggtctgatgggtttatcaggggtttccacttttgcttcttcctcatttttctcttgccgctgccaatgtaagaagtgccttgtgcctcccaccatgattctgaggcctccacagccatgtggaactggatgattaccacgaggatgggttctgccagccttaccggggaattgcctgtgcacgcttcattggcaaccggaccatttatgtggactcgcttcagatgcagggggagattgaaaaccgaatcacagcggccttcaccatgatcggcacgtctacgcacctgtcggaccagtgctcacagttcgccatcccatccttctgccacttcgtgtttcctctgtgcgacgcgcgctcccggacacccaagccgcgtgagctgtgccgcgacgagtgcgaggtgctggagagcgacctgtgccgccaggagtacaccatcgcccgctccaacccgctcatcctcatgcggcttcagctgcccaagtgtgaggcgctgcccatgcctgagagccccgacgctgccaactgcatgcgcattggcatcccagccgagaggctgggccgctaccatcagtgctataacggctcaggcatggattacagaggaacggcaagcaccaccaagtcaggccaccagtgccagccgtgggccctgcagcacccccacagccaccacctgtccagcacagacttccctgagcttggaggggggcacgcctactgccggaaccccggaggccagatggagggcccctggtgctttacgcagaataaaaacgtacgcatggaactgtgtgacgtaccctcgtgtagtccccgagacagcagcaagatggggattctgtacatcttggtccccagcatcgcaattccactggtcatcgcttgccttttcttcttggtttgcatgtgccggaataagcagaaggcatctgcgtccacaccgcagcggcgacagctgatggcctcgcccagccaagacatggaaatgcccctcattaaccagcacaaacaggccaaactcaaagagatcagcctgtctgcggtgaggttcatggaggagctgggagaggaccggtttgggaaagtctacaaaggtcacctgttcggccctgccccgggggagcagacccaggctgtggccatcaaaacgctgaaggacaaagcggaggggcccctgcgggaggagttccggcatgaggctatgctgcgagcacggctgcaacaccccaacgtcgtctgcctgctgggcgtggtgaccaaggaccagcccctgagcatgatcttcagctactgttcgcacggcgacctccacgaattcctggtcatgcgctcgccgcactcggacgtgggcagcaccgatgatgaccgcacggtgaagtccgccctggagccccccgacttcgtgcaccttgtggcacagatcgcggcggggatggagtacctatccagccaccacgtggttcacaaggacctggccacccgcaatgtgctagtgtacgacaagctgaacgtgaagatctcagacttgggcctcttccgagaggtgtatgccgccgattactacaagctgctggggaactcgctgctgcctatccgctggatggccccagaggccatcatgtacggcaagttctccatcgactcagacatctggtcctacggtgtggtcctgtgggaggtcttcagctacggcctgcagccctactgcgggtactccaaccaggatgtggtggagatgatccggaaccggcaggtgctgccttgccccgatgactgtcccgcctgggtgtatgccctcatgatcgagtgctggaacgagttccccagccggcggccccgcttcaaggacatccacagccggctccgagcctggggcaacctttccaactacaacagctcggcgcagacctcgggggccagcaacaccacgcagaccagctccctgagcaccagcccagtgagcaatgttgtaaggatgcgaggcagcgggaggcagtgctggatgacggagacgccaaacgctttgttgtggcataatgtgtctggagttggttcctgccggtgggttcgtggtctcgctgacttcaaggatgaagccaccgactttcgcgttatgccacgggaccccagcctgcactgccatgtgacttcaaccgcatga

SEQ ID NO: 7849 - DNA, 2657 bp, synthetic construct
  misc_feature 1..2657: note = Synthetic polypeptide
  source 1..2657: mol_type = other DNA
tgatacggtttggctgtgtccccacccaaatctcaacttgaattgtatctcccagaattcccacatgttgcaggagggatccagggggaggtaattgaatcacccacatgtagcgggagggacccagggggaggtaattgaatcatgggggtcggtctttcctgtgctgttcttgtcacagtaagtctcacgaggtctgatgggtttatcaggggtttccacttttgcttcttcctcatttttctcttgccgctgccaatgtaagaagtgccttgtgcctcccaccatgattctgaggcctccacagccatgtggaactggatgattaccacgaggatgggttctgccagccttaccggggaattgcctgtgcacgcttcattggcaaccggaccatttatgtggactcgcttcagatgcagggggagattgaaaaccgaatcacagcggccttcaccatgatcggcacgtctacgcacctgtcggaccagtgctcacagttcgccatcccatccttctgccacttcgtgtttcctctgtgcgacgcgcgctcccggacacccaagccgcgtgagctgtgccgcgacgagtgcgaggtgctggagagcgacctgtgccgccaggagtacaccatcgcccgctccaacccgctcatcctcatgcggcttcagctgcccaagtgtgaggcgctgcccatgcctgagagccccgacgctgccaactgcatgcgcattggcatcccagccgagaggctgggccgctaccatcagtgctataacggctcaggcatggattacagaggaacggcaagcaccaccaagtcaggccaccagtgccagccgtgggccctgcagcacccccacagccaccacctgtccagcacagacttccctgagcttggaggggggcacgcctactgccggaaccccggaggccagatggagggcccctggtgctttacgcagaataaaaacgtacgcatggaactgtgtgacgtaccctcgtgtagtccccgagacagcagcaagatggggattctgtacatcttggtccccagcatcgcaattccactggtcatcgcttgccttttcttcttggtttgcatgtgccggaataagcagaaggcatctgcgtccacaccgcagcggcgacagctgatggcctcgcccagccaagacatggaaatgcccctcattaaccagcacaaacaggccaaactcaaagagatcagcctgtctgcggtgaggttcatggaggagctgggagaggaccggtttgggaaagtctacaaaggtcacctgttcggccctgccccgggggagcagacccaggctgtggccatcaaaacgctgaaggacaaagcggaggggcccctgcgggaggagttccggcatgaggctatgctgcgagcacggctgcaacaccccaacgtcgtctgcctgctgggcgtggtgaccaaggaccagcccctgagcatgatcttcagctactgttcgcacggcgacctccacgaattcctggtcatgcgctcgccgcactcggacgtgggcagcaccgatgatgaccgcacggtgaagtccgccctggagccccccgacttcgtgcaccttgtggcacagatcgcggcggggatggagtacctatccagccaccacgtggttcacaaggacctggccacccgcaatgtgctagtgtacgacaagctgaacgtgaagatctcagacttgggcctcttccgagaggtgtatgccgccgattactacaagctgctggggaactcgctgctgcctatccgctggatggccccagaggccatcatgtacggcaagttctccatcgactcagacatctggtcctacggtgtggtcctgtgggaggtcttcagctacggcctgcagccctactgcgggtactccaaccaggatgtggtggagatgatccggaaccggcaggtgctgccttgccccgatgactgtcccgcctgggtgtatgccctcatgatcgagtgctggaacgagttccccagccggcggccccgcttcaaggacatccacagccggctccgagcctggggcaacctttccaactacaacagctcggcgcagacctcgggggccagcaacaccacgcagaccagctccctgagcaccagcccagtgagcaatgtgagcaacgcccgctacgtggggcccaagcagaaggccccgcccttcccacagccccagttcatccccatgaagggccagatcagacccatggtgcccccgccgcagctctacgtccccgtcaacggctaccagccggtgccggcctatggggcctacctgcccaacttctacccggtgcagatcccaatgcagatggccccgcagcaggtgcctcctcagatggtccccaagcccagctcacaccacagtggcagtggctccaccagcacaggctacgtcaccacggccccctccaacacatccatggcagacagggcagccctgctctcagagggcgctgatgacacacagaacgccccagaagatggggcccagagcaccgtgcaggaagcagaggaggaggaggaaggctctgtcccagagactgagctgctgggggactgtgacactctgcaggtggacgaggcccaagtccagctggaagcttga

SEQ ID NO: 7850 - DNA, 163 bp, synthetic construct; identical to SEQ ID NO: 480
  misc_feature 1..163: note = Synthetic polypeptide
  source 1..163: mol_type = other DNA

SEQ ID NO: 7851 - DNA, 104 bp, synthetic construct; identical to SEQ ID NO: 481
  misc_feature 1..104: note = Synthetic polypeptide
  source 1..104: mol_type = other DNA

SEQ ID NO: 7852 - DNA, 742 bp, synthetic construct; identical to SEQ ID NO: 6357
  misc_feature 1..742: note = Synthetic polypeptide
  source 1..742: mol_type = other DNA

SEQ ID NO: 7853 - DNA, 590 bp, synthetic construct; identical to SEQ ID NO: 6358
  misc_feature 1..590: note = Synthetic polypeptide
  source 1..590: mol_type = other DNA

SEQ ID NO: 7854 - DNA, 577 bp, synthetic construct; identical to SEQ ID NO: 6359
  misc_feature 1..577: note = Synthetic polypeptide
  source 1..577: mol_type = other DNA

SEQ ID NO: 7855 - DNA, 430 bp, synthetic construct; identical to SEQ ID NO: 6360
  misc_feature 1..430: note = Synthetic polypeptide
  source 1..430: mol_type = other DNA

SEQ ID NO: 7856 - DNA, 670 bp, synthetic construct; identical to SEQ ID NO: 6361
  misc_feature 1..670: note = Synthetic polypeptide
  source 1..670: mol_type = other DNA

SEQ ID NO: 7857 - DNA, 1767 bp, synthetic construct
  misc_feature 1..1767: note = Synthetic polypeptide
  source 1..1767: mol_type = other DNA
tgctctgctcatatcatcccccttgctgcctcctccgtgttaccaagactcagttcaggcatgaagtctccgtgggctctgagggttcggggctcttccggggtagaatttgtcgttcccacctctgttttccatggcactttgtacagactcctgtacaaagacctctgtacatgtgtcacgctgttttgtgatcatgtgtttctgtgtctgtctccctcagtagactgtgagctcctcgagggcaggaaccgtgtcttactcatctctgtattcccagcgcctagcacagtgcctggcacagaccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggagaagctgctacagctgcagaacttcaacacgctgatggcagtggtcgggggcctgagccacagctccatctcccgcctcaaggagacccacagccacgttagccctgagaccatcaagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgtctctggatcagtatcagacggaggatgagctgtaccagctgtccctgcagcgggagccgcgctccaagtcctcgccaaccagccccacgagttgcaccccaccaccccggcccccggtactggaggagtggacctcggctgccaaacccaagctggatcaggccctcgtggtggagcacatcgagaagatggtggagtctgtgttccggaactttgacgtcgatggggatggccacatctcacaggaagaattccagatcatccgtgggaacttcccttacctcagcgcctttggggacctcgaccagaaccaggatggctgcatcagcagggaggagatggtttcctatttcctgcgctccagctctgtgttgggggggcgcatgggcttcgtacacaacttccaggagagcaactccttgcgccccgtcgcctgccgccactgcaaagccctgatcctgggcatctacaagcagggcctcaaatgccgagcctgtggagtgaactgccacaagcagtgcaaggatcgcctgtcagttgagtgtcggcgcagggcccagagtgtgagcctggaggggtctgcaccctcaccctcacccatgcacagccaccatcaccgcgccttcagcttctctctgccccgccctggcaggcgaggctccaggcctccagcagagatccgtgaggaggaggtacagacggtggaggatggggtgtttgacatccacttgtaa

SEQ ID NO: 7858 - DNA, 1764 bp, synthetic construct
  misc_feature 1..1764: note = Synthetic polypeptide
  source 1..1764: mol_type = other DNA
tgctctgctcatatcatcccccttgctgcctcctccgtgttaccaagactcagttcaggcatgaagtctccgtgggctctgagggttcggggctcttccggggtagaatttgtcgttcccacctctgttttccatggcactttgtacagactcctgtacaaagacctctgtacatgtgtcacgctgttttgtgatcatgtgtttctgtgtctgtctccctcagtagactgtgagctcctcgagggcaggaaccgtgtcttactcatctctgtattcccagcgcctagcacagtgcctggcacagaccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggagaagctgctacagctgcagaacttcaacacgctgatggcagtggtcgggggcctgagccacagctccatctcccgcctcaaggagacccacagccacgttagccctgagaccatcaagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgtctctggatcagtatcagacggaggatgagctgtaccagctgtccctgcagcgggagccgcgctccaagtcctcgccaaccagccccacgagttgcaccccaccaccccggcccccggtactggaggagtggacctcggctgccaaacccaagctggatcaggccctcgtggtggagcacatcgagaagatggtggagtctgtgttccggaactttgacgtcgatggggatggccacatctcacaggaagaattccagatcatccgtgggaacttcccttacctcagcgcctttggggacctcgaccagaaccaggatggctgcatcagcagggaggagatggtttcctatttcctgcgctccagctctgtgttgggggggcgcatgggcttcgtacacaacttccaggagagcaactccttgcgccccgtcgcctgccgccactgcaaagccctgatcctgggcatctacaagcagggcctcaaatgccgagcctgtggagtgaactgccacaagcagtgcaaggatcgcctgtcagttgagtgtcggcgcagggcccagagtgtgagcctggaggggtctgcaccctcaccctcacccatgcacagccaccatcaccgcgccttcagcttctctctgccccgccctggcaggcgaggctccaggcctccagagatccgtgaggaggaggtacagacggtggaggatggggtgtttgacatccacttgtaa

SEQ ID NO: 7859 - DNA, 630 bp, synthetic construct
  misc_feature 1..630: note = Synthetic polypeptide
  source 1..630: mol_type = other DNA
tgctctgctcatatcatcccccttgctgcctcctccgtgttaccaagactcagttcaggcatgaagtctccgtgggctctgagggttcggggctcttccggggtagaatttgtcgttcccacctctgttttccatggcactttgtacagactcctgtacaaagacctctgtacatgtgtcacgctgttttgtgatcatgtgtttctgtgtctgtctccctcagtagactgtgagctcctcgagggcaggaaccgtgtcttactcatctctgtattcccagcgcctagcacagtgcctggcacagaccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggag

SEQ ID NO: 7860 - DNA, 405 bp, synthetic construct
  misc_feature 1..405: note = Synthetic polypeptide
  source 1..405: mol_type = other DNA
ggccaagcacaatgagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggaaaaggaccaagatggcggccgcaaactgacacctcagggacaaagagatctggacagaatcgccggacaggtggcagctgccaacaagaagcattag

SEQ ID NO: 7861 - DNA, 274 bp, synthetic construct
  misc_feature 1..274: note = Synthetic polypeptide
  source 1..274: mol_type = other DNA
ggccaagcacaatgagctctggcagccttcctcaaaaagtccgggaagctgaaagtccccgaatgggtggataccgtcaagctggccaagcacaaagagcttgctccctacgatgagaactggttctacacgcgagctggtggtttaatcctttctatatacacggaggcagactccctgggtttggatccatcttttacatctggctgtgtgtcctctgcttccacagcgcggcacctgtacctccggggtggcgctggggttggctccatga

SEQ ID NO: 7862 - DNA, 196 bp, synthetic construct
  misc_feature 1..196: note = Synthetic polypeptide
  source 1..196: mol_type = other DNA
ggccaagcacaatgagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgacca

SEQ ID NO: 7863 - DNA, 268 bp, synthetic construct
  misc_feature 1..268: note = Synthetic polypeptide
  source 1..268: mol_type = other DNA
ggccaagcacaatgagctctggcagccttcctcaaaaagtccgggaagctgaaagtccccgaatgggtggataccgtcaagctggccaagcacaaagagcttgctccctacgatgagaactggttctacacgcgagctggtgaggaacttagcttccacagcgcggcacctgtacctccggggtggcgctggggttggctccatgaccaagatctatgggggacgtcagagaaacggcgtcatgcccagccacttcagccgaggctcc

SEQ ID NO: 7864 - DNA, 186 bp, synthetic construct
  misc_feature 1..186: note = Synthetic polypeptide
  source 1..186: mol_type = other DNA
ggccaagcacaatgagctctggcagccttcctcaaaaagtccgggaagctgaaagtccccgaatgggtggataccgtcaagctggccaagcacaaagagcttgctccctacgatgagaactggttctacacgcgagctgagttgcactgtcaccaggctggagtacactggtgccgtctcggctaa

SEQ ID NO: 7865 - DNA, 695 bp, synthetic construct
  misc_feature 1..695: note = Synthetic polypeptide
  source 1..695: mol_type = other DNA
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtcctcggcagcctgatcttctgcttcggcatctggatcctcattgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagaaagacacaccgacctggaccaagggagacaggcataaacagctccaaagggaaacacacgggaaaaagagagaacaagagaaagaaatagacgccctgaaagaagagacagagacttatgagccgtag

SEQ ID NO: 7866 - DNA, 590 bp, synthetic construct
  misc_feature 1..590: note = Synthetic polypeptide
  source 1..590: mol_type = other DNA
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtcctcggcagcctgatcttctgcttcggcatctggatcctcattgacaagaccagcttcgtgtcctttgcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtag

SEQ ID NO: 7867 - DNA, 1070 bp, synthetic construct
  misc_feature 1..1070: note = Synthetic polypeptide
  source 1..1070: mol_type = other DNA
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtcctcggcagcctgatcttctgcttcggcatctggatcctcattgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttag

SEQ ID NO: 7868 - DNA, 1037 bp, synthetic construct
  misc_feature 1..1037: note = Synthetic polypeptide
  source 1..1037: mol_type = other DNA
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtcctcggcagcctgatcttctgcttcggcatctggatcctcattgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgaggtgatctggccccgcccccacccgcgatcggccctaaatccctag

SEQ ID NO: 7869 - DNA, 706 bp, synthetic construct
  misc_feature 1..706: note = Synthetic polypeptide
  source 1..706: mol_type = other DNA
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtcctcggcagcctgatcttctgcttcggcatctggatcctcattgacaagaccagcttcgtgtcctttgtgggcaggctacaggctcccatccactgctcaccggaggcttcttggagcctgagtcttcttccggcaaatggggttgtgcatacaaacaacaatgatcatgagagccatttctcaagcacttcctatctgtcgggacttgtggctggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggc

SEQ ID NO: 7870 - DNA, 1148 bp, synthetic construct; identical to SEQ ID NO: 436
  misc_feature 1..1148: note = Synthetic polypeptide
  source 1..1148: mol_type = other DNA

SEQ ID NO: 7871 - DNA, 3046 bp, synthetic construct
  misc_feature 1..3046: note = Synthetic polypeptide
  source 1..3046: mol_type = other DNA
tgatacggttaggctttgcgtccccacccaaatctcatcttgaattgtaatctccatcatccctacgtgtcaagggagagaccaggtggaggtagttgaatcatggggtggtttcccccatgctgttctcgtgatagtgagtgagttctcacaagatccgatggtattataaagggctcttcccctttcgctcggcacgtcttcctgctgctttgtgaaggaggtgttttgtgaccctttcgccatgattgtaaatttcctgaggccttcccagccatgctgaactatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttctgcctgcagtgcccaggagcttgtgaagctgctcaacgagctctttgcccgctttgacaagctggcagctaaataccaccagctgcggattaagatcctgggcgactgctactactgcatctgcggcttgcccgactaccgggaggaccacgccgtctgctccatcctcatggggctggccatggtggaggccatctcgtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggccctgcccaatggagcaccagcttcctcaaagtccagctcccctgccctcattgagaccaaggagcccaacgggagtgcccacagcagtgggtccacgtcggagaagcccgaggagcaggatgcccaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggctaatgacaaactatgtgaccttcatggtgggggagattctgctcctcatcctgaccatctgctccctggctgccatctttccccgggcctttcctaagaagcttgtggccttctcaacttggattgaccggacccgctgggccaggaacacctgggccatgctcgccatcttcatcctggtgatggcaaatgtcgtggacatgctcagctgtctccagtactacacgggacccagcaatgcaacggcagggatggaaacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgacttacctatggtggccttagagcagatgcaaggattcaaccctgggctcaatggcactgacaggctgcccctggtgccttccaagtactctatgacggtgatggtgttcctcatgatgctcagcttctactacttctcccgccacgtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggagctgtatagccagacgtatgatgagattggagtcatgtttgcctccctgcccaactttgctgacttctacacagaggagagcatcaacaatggtggtattgagtgtctgcgtttcctcaatgaaatcatctcagattttgactctctcctggacaatcccaagttccgggtgatcaccaagatcaaaaccattggcagcacgtatatggcggcttcaggagtcacccccgatgtcaacaccaatggctttgccagctccaacaaggaagacaagtccgagagagagcgctggcagcacctggctgacctggccgacttcgcgctggccatgaaggatacgctcaccaacatcaacaaccagtccttcaataacttcatgctgcgcataggcatgaacaaaggcggggttctggctggggtcatcggagcccggaaaccacactacgacatctggggcaatacagtcaatgtagccagcaggatggagtccacgggggtcatgggcaacattcaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctga

SEQ ID NO: 7872 - DNA, 741 bp, synthetic construct
  misc_feature 1..741: note = Synthetic polypeptide
  source 1..741: mol_type = other DNA
tgatacggttaggctttgcgtccccacccaaatctcatcttgaattgtaatctccatcatccctacgtgtcaagggagagaccaggtggaggtagttgaatcatggggtggtttcccccatgctgttctcgtgatagtgagtgagttctcacaagatccgatggtattataaagggctcttcccctttcgctcggcacgtcttcctgctgctttgtgaaggaggtgttttgtgaccctttcgccatgattgtaaatttcctgaggccttcccagccatgctgaactatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttctgcctgcagtgcccaggagcttgtgaagctgctcaacgagctctttgcccgctttgacaagctggcagctaaataccaccagctgcggattaagatcctgggcgactgctactactgcatctgcggcttgcc

SEQ ID NO: 7873 - DNA, 665 bp, synthetic construct; identical to SEQ ID NO: 6374
  misc_feature 1..665: note = Synthetic polypeptide
  source 1..665: mol_type = other DNA

SEQ ID NO: 7874 - DNA, 518 bp, synthetic construct; identical to SEQ ID NO: 6375
  misc_feature 1..518: note = Synthetic polypeptide
  source 1..518: mol_type = other DNA

SEQ ID NO: 7875 - DNA, 186 bp, synthetic construct; identical to SEQ ID NO: 7638
  misc_feature 1..186: note = Synthetic polypeptide
  source 1..186: mol_type = other DNA

SEQ ID NO: 7876 - DNA, 309 bp, synthetic construct
  misc_feature 1..309: note = Synthetic polypeptide
  source 1..309: mol_type = other DNA
tacatttagcctgagggatggctcttgagcccttaaataatgaactgcaacctaacttagtatgtaaactaactgaaagcttaaggcatgggagtatacttttgtaacaaatagctgagtctcagccaatcccagtagccgaacttcagtcggcggcagtcaaccctgcagccaagtgatcagactatgttcaaataaggccaactctgagctgtaaccaattaagctgtttctgtgtgtcacttcccttgtggaatggagctcactgaacctctctgatggctgcccgatcgttctgatgggtggtga

SEQ ID NO: 7877 - DNA, 213 bp, synthetic construct
  misc_feature 1..213: note = Synthetic polypeptide
  source 1..213: mol_type = other DNA
aagatttggggtcagagtcccaagctgcgtcatttagtagaagccgagtgactttgaacaaatcgttgcttttgtctgagcctgggtttcctcctgtacaaactgaaggagccaagccgccatggcctaccacagcttcctggtggagcccatcagctgccacgcctggaacaaggaccgcacccagattgccatctgccccaacaaccatga

SEQ ID NO: 7878 - DNA, 330 bp, synthetic construct; identical to SEQ ID NO: 6490
  misc_feature 1..330: note = Synthetic polypeptide
  source 1..330: mol_type = other DNA

SEQ ID NO: 7879 - DNA, 1306 bp, synthetic construct
  misc_feature 1..1306: note = Synthetic polypeptide
  source 1..1306: mol_type = other DNA
ccaacaacatatatatattttcaggaaaaagacctcctctacaaaagcaatttcaaaaaactggaagaaatgactgttgtaccacatgggcagatatcaatgtaagaacacaggaaacatgaaaaagcaaggaaatatgatacctccaaaggaacacacaattctccagcaaaaaaatcccaatcaaaaagaaattcacaaaaccccagatgaacaattcaaaatattgattttaaagaagctaaataagatataagagaattctgaaaaacaatagagagaattcagaaaaacagttcaggatatgaatgagaaatttatcaaagaaatagatatttttaaaagaaccaaacagaaattctggaactaaagattcattgaatgcaataaaaaatacatcccaaactccaccaatagactagatcaggcaaaagaaagaatctcagaacttgaagacaggtcttttgaaacaacctattcagacaaaaataaagagaaaagaataaaaaagaatgagcaaacccttcatgatatatggggcagtgtaaagcaactgaatattcaaatcatcagtgtccccaagggtgaagagagaatgaaagattagaaatcctatttaatgaaatattagatcaaaacttcccaaatataacaacaaacctagacatccagatgcaggaggcccaaaggtccccaaacagatacaatgcaaaatcatcttctccacagcacgttataatcaaaccacttaaagtcaaagcaaaagcaaatatactaaaaagagcaaaagaaaatcttctaattacccataaaggaaccaccattagactaacagtggatttctcagcagacaccttacaggccaggagagaaggggatgacattttcaaagtgctgaaagaaaaatactgccacccaaggagaccatgtccagcaaaactattcttcataaataaaagaaaaataaagcctttcccaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaa

SEQ ID NO: 7880 - DNA, 1130 bp, synthetic construct
  misc_feature 1..1130: note = Synthetic polypeptide
  source 1..1130: mol_type = other DNA
cagagtggctgagaggggctctggagccagctgcctggatttgaatcccagctgtgccacttaccagctgtgtgactgtaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcctgaagccatcaactttggctccttcaccatcaagtcagacgtctggtcctttggtatcctgctgatggagatcgtcacctacggccggatcccttacccagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatga

SEQ ID NO: 7881 - DNA, 871 bp, synthetic construct; identical to SEQ ID NO: 437
  misc_feature 1..871: note = Synthetic polypeptide
  source 1..871: mol_type = other DNA

SEQ ID NO: 7882 - DNA, 421 bp, synthetic construct; identical to SEQ ID NO: 441
  misc_feature 1..421: note = Synthetic polypeptide
  source 1..421: mol_type = other DNA

SEQ ID NO: 7883 - DNA, 638 bp, synthetic construct; identical to SEQ ID NO: 442
  misc_feature 1..638: note = Synthetic polypeptide
  source 1..638: mol_type = other DNA

SEQ ID NO: 7884 - DNA, 337 bp, synthetic construct; identical to SEQ ID NO: 443
  misc_feature 1..337: note = Synthetic polypeptide
  source 1..337: mol_type = other DNA

SEQ ID NO: 7885 - DNA, 1134 bp, synthetic construct
  misc_feature 1..1134: note = Synthetic polypeptide
  source 1..1134: mol_type = other DNA
tttcttggctccctgacccagaagcaaggtgactgacggaaggctgaggcagccccttaggtggcttaagcctgccctgtggagcatccctgtggggtactccgggcagcctgagtgatgagatccaaagagcgctcctgggtaggaaattgccccagtggaacacctcaccagatcaacacgtagcaggcccccgtggaggattaacacagtggctgaacaccgggaaggaactggcacttggagtctggacatctggaacttggaagacccactacattatttgagacaatggggaaagctgaaatgtggctcattcgaacctattgggattttgaatttcctcgcccattcttaccaaatgttgattttgttggaggacttcactgtaaaccagccaaacccttgcctaaggaaatggaagagtttgtgcagagctctggagaaaatggtattgtggtgttttctctggggtcgatgatcagtaacatgtcagaagaaagtgccaacatgattgcatcagcccttgcccagatcccacaaaaggttctatggagatttgatggcaagaagccaaatactttaggttccaatactcgactgtataagtggttaccccagaatgaccttcttggtcatcccaaaaccaaagcttttataactcatggtggaaccaatggcatctatgaggcaatctaccatgggatccctatggtgggcattcccttgtttgcggatcaacatgataacattgctcacatgaaagccaagggagcagccctcagtgtggacatcaggaccatgtcaagtagagatttgctcaatgcattgaagtcagtcattaatgaccctatctataaagagaatatcatgaaattatcaagaattcatcatgatcaaccggtgaagcccctggatcgagcagtcttctggattgagtttgtcatgcgccataaaggagccaagcaccttcgggtcgcagcccacaacctcacctggatccagtaccactctttggatgtgatagcattcctgctggcctgcgtggcaactatgatatttatgatcacaaaatgttgcctgttttgtttccgaaagcttgccaaaacaggaaagaagaagaaaagggattag

SEQ ID NO: 7886 - DNA, 423 bp, synthetic construct; identical to SEQ ID NO: 6550
  misc_feature 1..423: note = Synthetic polypeptide
  source 1..423: mol_type = other DNA

SEQ ID NO: 7887 - DNA, 1926 bp, synthetic construct; identical to SEQ ID NO: 7679
  misc_feature 1..1926: note = Synthetic polypeptide
  source 1..1926: mol_type = other DNA

SEQ ID NO: 7888 - DNA, 477 bp, synthetic construct; identical to SEQ ID NO: 7680
  misc_feature 1..477: note = Synthetic polypeptide
  source 1..477: mol_type = other DNA

SEQ ID NO: 7889 - DNA, 711 bp, synthetic construct; identical to SEQ ID NO: 7681
  misc_feature 1..711: note = Synthetic polypeptide
  source 1..711: mol_type = other DNA

SEQ ID NO: 7890 - DNA, 288 bp, synthetic construct; identical to SEQ ID NO: 7682
  misc_feature 1..288: note = Synthetic polypeptide
  source 1..288: mol_type = other DNA

SEQ ID NO: 7891 - DNA, 237 bp, synthetic construct; identical to SEQ ID NO: 7683
  misc_feature 1..237: note = Synthetic polypeptide
  source 1..237: mol_type = other DNA

SEQ ID NO: 7892 - DNA, 703 bp, synthetic construct; identical to SEQ ID NO: 7684
  misc_feature 1..703: note = Synthetic polypeptide
  source 1..703: mol_type = other DNA

SEQ ID NO: 7893 - DNA, 1942 bp, synthetic construct
  misc_feature 1..1942: note = Synthetic polypeptide
  source 1..1942: mol_type = other DNA
aacaccattttctagctgcacaaaactcaaggaacaaactaggaataaacctccccaagaaagcacaggggctttttaagaaggaacttctgaggactgcagagggaaacctgaattatggagacacatggtcctgaaaagaaagatgcaatactgtaaagcagcccctgtcaaagggaacaggaagcagtccacggagggtgacgccctagacccacctgcatcccccaaacctgctggcaagcagaacggaatccagaaccccatctcgctggaggactcccccgaggcaggcggggagcgggaggaggagcaggagcgggaggaggagcaggccttcctggtcagcctctacaagttcatgaaggagcgacacacgcccatcgagagggtgccccatctcggcttcaagcagattaacctgtggaagatctacaaagcagtggagaagctgggggcctatgagctggtgaccgggcgccgcctctggaagaacgtgtacgacgagctggggggcagcccaggcagcaccagcgcggccacgtgcacgcgccgccactacgagaggctggtcctgccatacgtgcggcacctgaagggggaggatgacaagccgctgcccacctccaagcccaggaaacagtacaagatggctaaggagaacaggggggatgatggggccaccgagaggccgaagaaggccaaggaggagcggcgcatggaccagatgatgccaggaaagaccaaagcagatgctgctgacccagcaccacttcccagccaggagccccccaggaacagcacagaacagcagggcctggcctctgggtcttctgtgtcctttgtgggtgccagcggctgtcctgaggcctacaagcggctcctatccagcttctactgcaaggggacacacggcatcatgtcaccactggccaaaaagaagctcctggcccaggtgagcaaggtggaggccttgcagtgccaggaggagggctgccgccatggggcagagccccaggcgtccccagctgttcacctcccagagagtccccagagccccaaagggctgactgagaactccaggcaccggctgacccctcaggagggattgcaggccccaggtggcagcctcagagaggaggcgcaggcaggcccctgcccggcagcccccatcttcaagggctgcttctacacccaccccaccgaggtgctgaagcctgtcagccagcaccccagggacttcttctctagacttaaagatggggtgctattggggcctcctggcaaagaggggctgtcagtgaaagagccccagctggtgtggggcggagacgctaaccgcccttctgcgttccataaaggtggctccagaaagggcatcctctaccccaagcccaaagcctgctgggtgtcccccatggccaaggtcccagccgagagccccacgctcccgcccaccttccccagtagcccaggcctgggcagcaagcgcagcctggaggaagagggtgctgcccacagtgggaagagactgcgggccgtgtctccctttcttaaggaggcggatgccaagaagtgtggggccaaacctgcagggtccggcctggtctcctgccttctgggcccagccctggggcctgtgcccccagaggcctacaggggcaccatgctgcactgcccgctgaacttcactggcaccccgggccccttgaagggccaggctgcactccccttcagccccctggtcatcccggccttcccggcccacttcctggccaccgcaggcccctcgcccatggccgctggcctgatgcacttccccccaacgtccttcgacagtgccctccgccacagactttgcccggcctcatctgcctggcacgcaccaccagtcacaacctatgcagcgccccacttcttccacctcaacaccaagctgtag

SEQ ID NO: 7894 - DNA, 334 bp, synthetic construct
  misc_feature 1..334: note = Synthetic polypeptide
  source 1..334: mol_type = other DNA
aacaccattttctagctgcacaaaactcaaggaacaaactaggaataaacctccccaagaaagcacaggggctttttaagaaggaacttctgaggactgcagagggaaacctgaattatggagacacatggtcctgaaaagaaagatgcaatactgtaaagcagcccctgtcaaagggaacaggaagcagtccacggagggtgacgccctagacccacctgcatcccccaaacctgctggcaagcagaacggaatccagaaccccatctcgctggagttaacctgtggaagatctacaaagcagtggagaagctgggggcctatgagctggtga

SEQ ID NO: 7895 - DNA, 259 bp, synthetic construct
  misc_feature 1..259: note = Synthetic polypeptide
  source 1..259: mol_type = other DNA
cttccggccaggacacacactccttggccccagtgcctgcgctagtcatcccgtgatcacttcatggcatttcccctccctttccagtctttgttccatggtcacctcagtgagaccttccttggctatttaaaatggcagcaacacagtcactcctggcggcaaaccaaacaaaaccagagtcatctggggaaaagtaactcgggcccatggaaacagtggcatggttcgtgccaaattccgaagcaatcttcctgct

SEQ ID NO: 7896 - DNA, 310 bp, synthetic construct
  misc_feature 1..310: note = Synthetic polypeptide
  source 1..310: mol_type = other DNA
cttccggccaggacacacactccttggccccagtgcctgcgctagtcatcccgtgatcacttcatggcatttcccctccctttccagtctttgttccatggtcacctcagtgagaccttccttggctatttaaaatggcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaa

SEQ ID NO: 7897 - DNA, 204 bp, synthetic construct
  misc_feature 1..204: note = Synthetic polypeptide
  source 1..204: mol_type = other DNA
ggctgggcatggtggctcatcacgcctgtaatcccagcactttgggaggccgaggcaggcggatcacctgagatacaaactggactctcaggacaaaacgacaccagccaaaccagcagcccctcagcatccagcaacataagcggaggcattttccttttcttcgtggccaatgccataatccacctcttctgcttcagttga

SEQ ID NO: 7898 - DNA, 1033 bp, synthetic construct; identical to SEQ ID NO: 7576
  misc_feature 1..1033: note = Synthetic polypeptide
  source 1..1033: mol_type = other DNA

SEQ ID NO: 7899 - DNA, 1048 bp, synthetic construct; identical to SEQ ID NO: 7577
  misc_feature 1..1048: note = Synthetic polypeptide
  source 1..1048: mol_type = other DNA

SEQ ID NO: 7900 - DNA, 990 bp, synthetic construct
  misc_feature 1..990: note = Synthetic polypeptide
  source 1..990: mol_type = other DNA
gctgggcgcagtggctcatgcctgtaatgccagcactttgagaggccgaggcgggaagatcacgagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtgagtcactggaactggaggacccgtcttctgggctgggtgtgaccaagcaggatctgggcccaggtaagggccttgcagaggggcatctggtcaccagcagctcatccccagcagggccagctcctttgtgggcaggtgaaggagtgtga

SEQ ID NO: 7901 - DNA, 471 bp, synthetic construct
  misc_feature 1..471: note = Synthetic polypeptide
  source 1..471: mol_type = other DNA
gctgggcgcagtggctcatgcctgtaatgccagcactttgagaggccgaggcgggaagatcacgagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagtactga

SEQ ID NO: 7902 - DNA, 507 bp, synthetic construct
  misc_feature 1..507: note = Synthetic polypeptide
  source 1..507: mol_type = other DNA
gctgggcgcagtggctcatgcctgtaatgccagcactttgagaggccgaggcgggaagatcacgagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagagtcactggaactggaggacccgtcttctgggctgggtgtga

SEQ ID NO: 7903 - DNA, 723 bp, synthetic construct
  misc_feature 1..723: note = Synthetic polypeptide
  source 1..723: mol_type = other DNA
gctgggcgcagtggctcatgcctgtaatgccagcactttgagaggccgaggcgggaagatcacgagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagagtcactggaactggaggacccgtcttctgggctgggtgtgaccaagcaggatctgggcccagtccccatgtga

SEQ ID NO: 7904 - DNA, 483 bp, synthetic construct
  misc_feature 1..483: note = Synthetic polypeptide
  source 1..483: mol_type = other DNA
gctgggcgcagtggctcatgcctgtaatgccagcactttgagaggccgaggcgggaagatcacgagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccaggaagtggccaaaagctag

SEQ ID NO: 7905 - DNA, 915 bp, synthetic construct
  misc_feature 1..915: note = Synthetic polypeptide
  source 1..915: mol_type = other DNA
gctgggcgcagtggctcatgcctgtaatgccagcactttgagaggccgaggcgggaagatcacgagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtgagtcactggaactggaggacccgtcttctgggctgggtgtgaccaagcaggatctgggcccagtccccatgtga

SEQ ID NO: 7906 - DNA, 393 bp, synthetic construct
  misc_feature 1..393: note = Synthetic polypeptide
  source 1..393: mol_type = other DNA
gctgggcgcagtggctcatgcctgtaatgccagcactttgagaggccgaggcgggaagatcacgagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagccccatgcagaatgccaccaagtatggcaacatgacagaggaccatgtgatgcacctgctccagaatgctga

SEQ ID NO: 7907 - DNA, 183 bp, synthetic construct
  misc_feature 1..183: note = Synthetic polypeptide
  source 1..183: mol_type = other DNA
gctgggcgcagtggctcatgcctgtaatgccagcactttgagaggccgaggcgggaagatcacgagccagtcatggatgaccagcgcgaccttatctccaacaatgagcaactgcccatgctgggccggcgccctggggccccggagagcccatgcagaatgccaccaagtatggcaacatga

SEQ ID NO: 7908 - DNA, 832 bp, synthetic construct
  misc_feature 1..832: note = Synthetic polypeptide
  source 1..832: mol_type = other DNA
gatttaaatgagattgccagcctagagagggtctctattggcatgccgtagagctctgccattggctattttttgtagaacttattaatgacttggatgaagaaaaggaagacctgtgtgttaagttagtggatggcttaaagctgtgtgctgtcaccattcatgagacgatgcaattgagattccaaaagattttgcaattttgctggtctggaagatgtccaaataaggaatgaaattcagtggagatggatgtaaaatcctacccttaagccccatagcatccatcatcatccaaggacggacggagaagcagcacatgcagataaagcttgcatttctctgcaggctcagagagaatcctcagcggcttgggcccagcacaggagaggtcactgccacacatttgcccttggcatggtctccagaaccatgcattgcatcctgggagcaacattttctgagatattctggtaaattggagtgtgtgttggtgagggtccccagaatggcaaagaagagcctgatgcaaggaactcagaggacctgagatgctgtatcctaacatttcaagaactgcgatattgaaaaaagcattggatctactagatgtggttctattaaatggaaccaaacccaacaggaatatgagagcctggagcaagaaaacaccatgctgcggagagagatcgggaagctgacagaggagctgaagcacctgacagaggcactgaaggagcacgagaagatgtgcccgctgctgctctgccctatgaactttgtgccagtgcctccccggccggaccctgtggccggctgcttgccccgatga

SEQ ID NO: 7909 - DNA, 1332 bp, synthetic construct
  misc_feature 1..1332: note = Synthetic polypeptide
  source 1..1332: mol_type = other DNA
gtaaccatcataaaaaattcaacaagtaacgacaaattctcttgaagcaagtaaaaaaaaatggaaattctcagtgaagaaataggaattaacaaaaaagaaccaaatggaaactatagaaccaaaaaataacacaaataataaaactaactggatgagcttaatagtacagtggagatgacagagaatagaaattgaggacagatcaatagaatgttcccgatctgaacaaccgataaacaataaactgaaaacagagtctcagaaacctgtgggacaataacaaagatccaacatttatagcattgacatcctagaaggagaagagtgaaacaatgggactaaaagagtactaaaagaagtaatggctggaaattccccacatttggcaaaaaatagaaacctacagattcaagaggctgagagaactccgacaggataaacccaaagcaatcaatgccaagaaacattataattaaatttctgaaaactacagacaaagaaaaaaatttgaaagcagccagggagaaacaatgcatggccaaacacccatttgaatggcagcatatttctcatctaaagcaacagcagcctgaaggaagtgacaaaagatttttcaactgatgaaagagaagaactgtcaacagaaaattctgtatctggtgaaactatatttcacgagtgaatggggaaatacgttctcacataaagggaatctaaaagaattgtcactagcagatctcttcttaaagaatggctaaaggaagttcttcgaaagaaaggaaatgataaagaaaggatcttagacgatcaggaagaaggaaagaacaagggagaaagcagaaatatggaaaattggccctgaaacaccatccagacaagaatccagatgatccagctgctactgagaagtttaaagaaatcaacaacgcccacgcaatacttaccgacatttcaaagagaagcatatacgacaagtacggatcgctgggactctacgtggccgagcagtttggagacgaaaacgttaacacctacttcatgctgtcgagctggtgggcaaaggccctgtttgtcatcgttggcctcttgacgggctgctacttttgctgctgcctgtgctgctgctgcaactgctgctgtggacactgccggcccgagtcatcagtgccagaagaggacttctatgtgtccccagaggatctggaggagcagatcaagtctgacatggaaaaagatgtggactttccagtttttctccagcctacaaatgcaaatgagaaaacacagctaatcaaagaaggatctcgaagttattgcacagactcttga

SEQ ID NO: 7910 - DNA, 1021 bp, synthetic construct
  misc_feature 1..1021: note = Synthetic polypeptide
  source 1..1021: mol_type = other DNA
gtaaccatcataaaaaattcaacaagtaacgacaaattctcttgaagcaagtaaaaaaaaatggaaattctcagtgaagaaataggaattaacaaaaaagaaccaaatggaaactatagaaccaaaaaataacacaaataataaaactaactggatgagcttaatagtacagtggagatgacagagaatagaaattgaggacagatcaatagaatgttcccgatctgaacaaccgataaacaataaactgaaaacagagtctcagaaacctgtgggacaataacaaagatccaacatttatagcattgacatcctagaaggagaagagtgaaacaatgggactaaaagagtactaaaagaagtaatggctggaaattccccacatttggcaaaaaatagaaacctacagattcaagaggctgagagaactccgacaggataaacccaaagcaatcaatgccaagaaacattataattaaatttctgaaaactacagacaaagaaaaaaatttgaaagcagccagggagaaacaatgcatggccaaacacccatttgaatggcagcatatttctcatctaaagcaacagcagcctgaaggaagtgacaaaagatttttcaactgatgaaagagaagaactgtcaacagaaaattctgtatctggtgaaactatatttcacgagtgaatggggaaatacgttctcacataaagggaatctaaaagaattgtcactagcagatctcttcttaaagaatggctaaaggaagttcttcgaaagaaaggaaatgataaagaaaggatcttagacgatcaggaagaaggaaagaacaagggagaaagcagaaatatggaaaattggccctgaaacaccatccagacaagaatccagatgatccagctgctactgagaagtttaaagaaatcaacaacgcccacgcaatacttaccgacatttcaaagagaagcatatacgacaagtacggatcgctgggactctacgtggccgagcagtttggagacg

SEQ ID NO: 7911 - DNA, 1883 bp, synthetic construct; identical to SEQ ID NO: 6345
  misc_feature 1..1883: note = Synthetic polypeptide
  source 1..1883: mol_type = other DNA

SEQ ID NO: 7912 - DNA, 118 bp, synthetic construct
  misc_feature 1..118: note = Synthetic polypeptide
  source 1..118: mol_type = other DNA
ggcgagaggcggcggcgggagcggcgtttcatccaggatcgagcagggcgaatggggggggaggcacccgagctggccctggacccggtgcctcaggatgcgtccaccaagaagctga

SEQ ID NO: 7913 - DNA, 435 bp, synthetic construct
  misc_feature 1..435: note = Synthetic polypeptide
  source 1..435: mol_type = other DNA
ggcgagaggcggcggcgggagcggcgtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggctggcgtgaaatggcgtgatctgggctcactgcaacctctgcctcctgggttcaagcgattcacctgcctcagcatcccaaggagctgggattacaggccctgtgcaccaaggtgccggaactga

SEQ ID NO: 7914 - DNA, 519 bp, synthetic construct
  misc_feature 1..519: note = Synthetic polypeptide
  source 1..519: mol_type = other DNA
ggcgagaggcggcggcgggagcggcgtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctga

SEQ ID NO: 7915 - DNA, 480 bp, synthetic construct
  misc_feature 1..480: note = Synthetic polypeptide
  source 1..480: mol_type = other DNA
ggcgagaggcggcggcgggagcggcgtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttggaccgtgaccatctttgtggcgggagtgctcaccgcctcactcaccatctggaagaagatgggctga

SEQ ID NO: 7916 - DNA, 597 bp, synthetic construct
  misc_feature 1..597: note = Synthetic polypeptide
  source 1..597: mol_type = other DNA
ggcgagaggcggcggcgggagcggcgtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggtgagactcctcaagcctcctcacccccaccaccgcgccctcaccaccgcccctgccccaccgtccctgccccccgccactcctctgggaccctgggccttctggagcaggtcacagtggtgccctctccccatcttcagatcatcagatgtggtctataatgcgttttccttacgtgtctga

SEQ ID NO: 7917 - DNA, 368 bp, synthetic construct
  misc_feature 1..368: note = Synthetic polypeptide
  source 1..368: mol_type = other DNA
tgatatggtttggctgtgtccccatccaaatctcaccttgaattgtagctcccataattcccacgtgttgtgggaggaacctaatcagagttaattgaatcataggggtgatttcccccatgctgttcttgaagtagtgaataagtctcacgagatctgaatgttttataaggggaaatccctttcacttggttttcattctctctcgtctgccaccatgaaagatgtgcgtttcacgttccactatgattgtgaggcctccccagctgcatggaactccaacatcccatgcaccatcgtggagactggctggatgccctgtgctctatcagggcatgtcagaccaacagaggggcaaatcagagtga

SEQ ID NO: 7918 - DNA, 421 bp, synthetic construct
  misc_feature 1..421: note = Synthetic polypeptide
  source 1..421: mol_type = other DNA
tgatatggtttggctgtgtccccatccaaatctcaccttgaattgtagctcccataattcccacgtgttgtgggaggaacctaatcagagttaattgaatcataggggtgatttcccccatgctgttcttgaagtagtgaataagtctcacgagatctgaatgttttataaggggaaatccctttcacttggttttcattctctctcgtctgccaccatgaaagatgtgcgtttcacgttccactatgattgtgaggcctccccagctgcatggaactccaacatcccatgcaccatcgtggagactggctggatgccctgtgctctatcagggcatgtcagaccaacagaggggcaaatcagagtgaagaggaagccagaagatgggagagacatttttgaaggaacaagctgccaataa

SEQ ID NO: 7919 - DNA, 753 bp, synthetic construct
  misc_feature 1..753: note = Synthetic polypeptide
  source 1..753: mol_type = other DNA
aaacatcattcttcatggggaaacctggggaaaagccccacttgaagtaaggaacgagaccgggaagcagccctgtgggagatggaagagcaccagctgcaggagaggcaccagctggtgaagcagcagctcaaagaccagtacttcctccagcggcacgagctgctgcgcaagcatgagaaggagcgggagcagatgcagcgctacaaccagcgcatgatagagcagctgaaggtgcggcagcaacaggaaaaggcgcggctgcccaagatccagaggagtgagggcaagacgcgcatggccatgtacaagaagagcctccacatcaacggcgggggcagcgcagctgagcagcgtgagaagatcaagcagttctcccagcaggaggagaagaggcagaagtcggagcggctgcagcaacagcagaaacacgagaaccagatgcgggacatgctggcgcagtgtgagagcaacatgagcgagctgcagcagctgcagaatgaaaagtgccacctcctggtagagcacgaaacccagaaactgaaggccctggatgagagccataaccagaacctgaaggaatggcgggacaagcttcggccgcgcaagaaggctctggaagaggatctgaaccagaagaagcgggagcaggagatgttcttcaagctgagcgaggaggcggagtgcccaaacccctccaccccaagcaaggccgccaagttcttcccctacagttctgcggatgcttcttaa

SEQ ID NO: 7920 - DNA, 873 bp, synthetic construct
  misc_feature 1..873: note = Synthetic polypeptide
  source 1..873: mol_type = other DNA
aaacatcattcttcatggggaaacctggggaaaagccccacttgaagtaaggaacgagaccgggaagcagccctgtgggagatggaagagcaccagctgcaggagaggcaccagctggtgaagcagcagctcaaagaccagtacttcctccagcggcacgagctgctgcgcaagcatgagaaggagcgggagcagatgcagcgctacaaccagcgcatgatagagcagctgaaggtgcggcagcaacaggaaaaggcgcggctgcccaagatccagaggagtgagggcaagacgcgcatggccatgtacaagaagagcctccacatcaacggcgggggcagcgcagctgagcagcgtgagaagatcaagcagttctcccagcaggaggagaagaggcagaagtcggagcggctgcagcaacagcagaaacacgagaaccagatgcgggacatgctggcgcagtgtgagagcaacatgagcgagctgcagcagctgcagaatgaaaagtgccacctcctggtagagcacgaaacccagaaactgaaggccctggatgagagccataaccagaacctgaaggaatggcgggacaagcttcggccgcgcaagaagatggagtctcgcaccgtcgcccaagttggagtgcagtggcgcaatctcaactcaggctctggaagaggatctgaaccagaagaagcgggagcaggagatgttcttcaagctgagcgaggaggcggagtgcccaaacccctccaccccaagcaaggccgccaagttcttcccctacagttctgcggatgcttcttaacaaccgcccggggctgtggctggcagcttggtgggccccagggccttctccttcattctctgtga

SEQ ID NO: 7921 - DNA, 848 bp, synthetic construct
  misc_feature 1..848: note = Synthetic polypeptide
  source 1..848: mol_type = other DNA
ggccgggcgcggtggctcacccctgtaatcccagcagtttgggaggccgaggcgggtgcatcatctaaggtcaagagttcgagacaagtctggccaagatggggaaactgactctactctgtgatgccaagacagatgggagtttccttgtacaccactttctctccttctatctcaaagctaattgtaaagtctgctttgtggcactcatccagtccttcagccactacagtatcgtgggacagaagctgggtgtcagcctgaccatggcgcgggagcgtgggcagcttgtgttccttgagggactcaagtctgcagtggacgtcgtcttccaggctcaaaaggagccacaccccctgcagtttctcagggaggctaatgctgggaacttgaaaccattgtttgagtttgtacgggaggccctgaagccagtagacagtggagaggctcggtggacgtacccggtgctgttggtggacgacctcagtgtgctcctgagcctgggcatgggggcggtggctgtgctagacttcattcactactgcagagccaccgtgtgctgggaactaaagggaaacatggtggtccttgtgcacgacagtggagatgcggaggatgaggagaatgacatcctgctgaatggcctcagtcatcagagccatctgatactgcgggctgagggcctggccactggcttctgcagggatgtgcacgggcagctgaggatcctgtggaggagaccatcgcagcccgcagtccaccgggatcagagcttcacttaccagtataagatacaggacaaaagcgtgtccttttttgccaaaggaatgtctcctgctgttctgtga

SEQ ID NO: 7922 - DNA, 230 bp, synthetic construct
  misc_feature 1..230: note = Synthetic polypeptide
  source 1..230: mol_type = other DNA
ggccgggcgcggtggctcacccctgtaatcccagcagtttgggaggccgaggcgggtgcatcatctaaggtcaagagttcgagacaagtctggccaagatggggaaactgactctactctgtgatgccaagacagatgggagtttccttgtacaccactttctctccttctatctcaaagggtgtcagcctgaccatggcgcgggagcgtgggcagcttgtgttccttga

SEQ ID NO: 7923 - DNA, 369 bp, synthetic construct; identical to SEQ ID NO: 6492
  misc_feature 1..369: note = Synthetic polypeptide
  source 1..369: mol_type = other DNA

SEQ ID NO: 7924 - DNA, 654 bp, synthetic construct; identical to SEQ ID NO: 6998
  misc_feature 1..654: note = Synthetic polypeptide
  source 1..654: mol_type = other DNA

SEQ ID NO: 7925 - DNA, 651 bp, synthetic construct; identical to SEQ ID NO: 6999
  misc_feature 1..651: note = Synthetic polypeptide
  source 1..651: mol_type = other DNA

SEQ ID NO: 7926 - DNA, 498 bp, synthetic construct; identical to SEQ ID NO: 7000
  misc_feature 1..498: note = Synthetic polypeptide
  source 1..498: mol_type = other DNA

SEQ ID NO: 7927 - DNA, 189 bp, synthetic construct; identical to SEQ ID NO: 7001
  misc_feature 1..189: note = Synthetic polypeptide
  source 1..189: mol_type = other DNA

SEQ ID NO: 7928 - DNA, 3616 bp, synthetic construct
  misc_feature 1..3616: note = Synthetic polypeptide
  source 1..3616: mol_type = other DNA
agaggattatgtgtacatggcagaatctatcccgccacctagacaacaattactctttccaagtctgtctgatgtatctattttgggaccctggtgtctaatcaaaattggcaacttccagaaggaggcttggacagtgagttgtacttaatttcagtgagtttcagctcttaacacaatagtggctgcacatcctctacccctagccctgtggcaggctttccagatgtgcatacattccagtagcagcttgtgctcaacgtgcaggggccgaatgggaaaaaatgaaccctgtcctacaaataacagggatctatgttgtgatcactgatgcctgcctctgaacacaaaggtacagacaaagaaatggcaaccatgtgtttgcaactctccctattgttgtaagcacctccccctctggctgaagtgacttccaggggatttaaagagcttgtgccttttcctgtgtctccttcatttttctccttttccctttttgggagccagacattgaagactaagacattcaaaagcaaccacatatatggggtaagttggaaagacattgaacttgcccaggggaaggtgcagcctcagaaaagacctaagaagactcttaagtgtgcagttcaggctgatccttggcaacctacaacaattacaataaacaaacaaaatccagcaaatccttgaggaagggagacaatctgatttccagagttaccatatcattagattcagatatccagttgttagcaaaaaattatgaggcataaaaagaaacaaaaacgtatggcccactcaaaggggaaaacaaagaccaacagaaacagtgcctgatgaagacctgatggcacatctactagacaaagacttttaaaaaaatcttaaagatgcttaaaaaactgaaggaaaatttggagaaagtcaagaaaatggtgtatgcattaaatgaaaatatcaaaaaagagatagaaaacataagaaagaaactaaaaagaaatgcgggagctgaaaagtacaataactgaaatgaaaattttaaaagagggattcaaaggcagatttgagcaggcagaagaaagaatcaacaaacttgtagataagacagtgaaaattatcaagtatgagaaatacaaagaaaaaaatataagaaaagtgatcagagcctaagagacatctgggttaccattaagtggaccagcttactcattgtgggagtcctaaaaggaaaagagagaagggtgcagagagaatatttgaagaaataatgatggaaaacttcccaaatttgatgaaagacatgaatataaacatccaagaagttcaatgacagctgatgaactgaaagagacccacatcgagatacactataatcaaactatccaaagtcaaagagaattttgaaaacagtgagggaaaactgatttgtctcatacaaggaattttcaataagattatgggcaaatttatcgtcagaaactttgaaggccagaagtagtggtctgatatatttaaagtgctatttttttcagctgtcaactagaaattttatacgcagaaaaaatattctccaaaagcaagggagaaattaagacattctcagataaacagaagctgaaggagttttttacttgtctttgcagtaaatgctaaagggagtccttcctgcaggttgatataaaaggacactaaacaataacttgatgccatatgaagaaaaaaagatctcagcaaagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaa

SEQ ID NO: 7929 - DNA, 3619 bp, synthetic construct
  misc_feature 1..3619: note = Synthetic polypeptide
  source 1..3619: mol_type = other DNA
agaggattatgtgtacatggcagaatctatcccgccacctagacaacaattactctttccaagtctgtctgatgtatctattttgggaccctggtgtctaatcaaaattggcaacttccagaaggaggcttggacagtgagttgtacttaatttcagtgagtttcagctcttaacacaatagtggctgcacatcctctacccctagccctgtggcaggctttccagatgtgcatacattccagtagcagcttgtgctcaacgtgcaggggccgaatgggaaaaaatgaaccctgtcctacaaataacagggatctatgttgtgatcactgatgcctgcctctgaacacaaaggtacagacaaagaaatggcaaccatgtgtttgcaactctccctattgttgtaagcacctccccctctggctgaagtgacttccaggggatttaaagagcttgtgccttttcctgtgtctccttcatttttctccttttccctttttgggagccagacattgaagactaagacattcaaaagcaaccacatatatggggtaagttggaaagacattgaacttgcccaggggaaggtgcagcctcagaaaagacctaagaagactcttaagtgtgcagttcaggctgatccttggcaacctacaacaattacaataaacaaacaaaatccagcaaatccttgaggaagggagacaatctgatttccagagttaccatatcattagattcagatatccagttgttagcaaaaaattatgaggcataaaaagaaacaaaaacgtatggcccactcaaaggggaaaacaaagaccaacagaaacagtgcctgatgaagacctgatggcacatctactagacaaagacttttaaaaaaatcttaaagatgcttaaaaaactgaaggaaaatttggagaaagtcaagaaaatggtgtatgcattaaatgaaaatatcaaaaaagagatagaaaacataagaaagaaactaaaaagaaatgcgggagctgaaaagtacaataactgaaatgaaaattttaaaagagggattcaaaggcagatttgagcaggcagaagaaagaatcaacaaacttgtagataagacagtgaaaattatcaagtatgagaaatacaaagaaaaaaatataagaaaagtgatcagagcctaagagacatctgggttaccattaagtggaccagcttactcattgtgggagtcctaaaaggaaaagagagaagggtgcagagagaatatttgaagaaataatgatggaaaacttcccaaatttgatgaaagacatgaatataaacatccaagaagttcaatgacagctgatgaactgaaagagacccacatcgagatacactataatcaaactatccaaagtcaaagagaattttgaaaacagtgagggaaaactgatttgtctcatacaaggaattttcaataagattatgggcaaatttatcgtcagaaactttgaaggccagaagtagtggtctgatatatttaaagtgctatttttttcagctgtcaactagaaattttatacgcagaaaaaatattctccaaaagcaagggagaaattaagacattctcagataaacagaagctgaaggagttttttacttgtctttgcagtaaatgctaaagggagtccttcctgcaggttgatataaaaggacactaaacaataacttgatgccatatgaagaaaaaaagatctcagcaaagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaa

SEQ ID NO: 7930 - DNA, 3499 bp, synthetic construct
  misc_feature 1..3499: note = Synthetic polypeptide
  source 1..3499: mol_type = other DNA
agaggattatgtgtacatggcagaatctatcccgccacctagacaacaattactctttccaagtctgtctgatgtatctattttgggaccctggtgtctaatcaaaattggcaacttccagaaggaggcttggacagtgagttgtacttaatttcagtgagtttcagctcttaacacaatagtggctgcacatcctctacccctagccctgtggcaggctttccagatgtgcatacattccagtagcagcttgtgctcaacgtgcaggggccgaatgggaaaaaatgaaccctgtcctacaaataacagggatctatgttgtgatcactgatgcctgcctctgaacacaaaggtacagacaaagaaatggcaaccatgtgtttgcaactctccctattgttgtaagcacctccccctctggctgaagtgacttccaggggatttaaagagcttgtgccttttcctgtgtctccttcatttttctccttttccctttttgggagccagacattgaagactaagacattcaaaagcaaccacatatatggggtaagttggaaagacattgaacttgcccaggggaaggtgcagcctcagaaaagacctaagaagactcttaagtgtgcagttcaggctgatccttggcaacctacaacaattacaataaacaaacaaaatccagcaaatccttgaggaagggagacaatctgatttccagagttaccatatcattagattcagatatccagttgttagcaaaaaattatgaggcataaaaagaaacaaaaacgtatggcccactcaaaggggaaaacaaagaccaacagaaacagtgcctgatgaagacctgatggcacatctactagacaaagacttttaaaaaaatcttaaagatgcttaaaaaactgaaggaaaatttggagaaagtcaagaaaatggtgtatgcattaaatgaaaatatcaaaaaagagatagaaaacataagaaagaaactaaaaagaaatgcgggagctgaaaagtacaataactgaaatgaaaattttaaaagagggattcaaaggcagatttgagcaggcagaagaaagaatcaacaaacttgtagataagacagtgaaaattatcaagtatgagaaatacaaagaaaaaaatataagaaaagtgatcagagcctaagagacatctgggttaccattaagtggaccagcttactcattgtgggagtcctaaaaggaaaagagagaagggtgcagagagaatatttgaagaaataatgatggaaaacttcccaaatttgatgaaagacatgaatataaacatccaagaagttcaatgacagctgatgaactgaaagagacccacatcgagatacactataatcaaactatccaaagtcaaagagaattttgaaaacagtgagggaaaactgatttgtctcatacaaggaattttcaataagattatgggcaaatttatcgtcagaaactttgaaggccagaagtagtggtctgatatatttaaagtgctatttttttcagctgtcaactagaaattttatacgcagaaaaaatattctccaaaagcaagggagaaattaagacattctcagataaacagaagctgaaggagttttttacttgtctttgcagtaaatgctaaagggagtccttcctgcaggttgatataaaaggacactaaacaataacttgatgccatatgaagaaaaaaagatctcagcaaagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaa

SEQ ID NO: 7931 - DNA, 2098 bp, synthetic construct
  misc_feature 1..2098: note = Synthetic polypeptide
  source 1..2098: mol_type = other DNA
agaggattatgtgtacatggcagaatctatcccgccacctagacaacaattactctttccaagtctgtctgatgtatctattttgggaccctggtgtctaatcaaaattggcaacttccagaaggaggcttggacagtgagttgtacttaatttcagtgagtttcagctcttaacacaatagtggctgcacatcctctacccctagccctgtggcaggctttccagatgtgcatacattccagtagcagcttgtgctcaacgtgcaggggccgaatgggaaaaaatgaaccctgtcctacaaataacagggatctatgttgtgatcactgatgcctgcctctgaacacaaaggtacagacaaagaaatggcaaccatgtgtttgcaactctccctattgttgtaagcacctccccctctggctgaagtgacttccaggggatttaaagagcttgtgccttttcctgtgtctccttcatttttctccttttccctttttgggagccagacattgaagactaagacattcaaaagcaaccacatatatggggtaagttggaaagacattgaacttgcccaggggaaggtgcagcctcagaaaagacctaagaagactcttaagtgtgcagttcaggctgatccttggcaacctacaacaattacaataaacaaacaaaatccagcaaatccttgaggaagggagacaatctgatttccagagttaccatatcattagattcagatatccagttgttagcaaaaaattatgaggcataaaaagaaacaaaaacgtatggcccactcaaaggggaaaacaaagaccaacagaaacagtgcctgatgaagacctgatggcacatctactagacaaagacttttaaaaaaatcttaaagatgcttaaaaaactgaaggaaaatttggagaaagtcaagaaaatggtgtatgcattaaatgaaaatatcaaaaaagagatagaaaacataagaaagaaactaaaaagaaatgcgggagctgaaaagtacaataactgaaatgaaaattttaaaagagggattcaaaggcagatttgagcaggcagaagaaagaatcaacaaacttgtagataagacagtgaaaattatcaagtatgagaaatacaaagaaaaaaatataagaaaagtgatcagagcctaagagacatctgggttaccattaagtggaccagcttactcattgtgggagtcctaaaaggaaaagagagaagggtgcagagagaatatttgaagaaataatgatggaaaacttcccaaatttgatgaaagacatgaatataaacatccaagaagttcaatgacagctgatgaactgaaagagacccacatcgagatacactataatcaaactatccaaagtcaaagagaattttgaaaacagtgagggaaaactgatttgtctcatacaaggaattttcaataagattatgggcaaatttatcgtcagaaactttgaaggccagaagtagtggtctgatatatttaaagtgctatttttttcagctgtcaactagaaattttatacgcagaaaaaatattctccaaaagcaagggagaaattaagacattctcagataaacagaagctgaaggagttttttacttgtctttgcagtaaatgctaaagggagtccttcctgcaggttgatataaaaggacactaaacaataacttgatgccatatgaagaaaaaaagatctcagcaaagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtga

SEQ ID NO: 7932 - DNA, 1957 bp, synthetic construct
  misc_feature 1..1957: note = Synthetic polypeptide
  source 1..1957: mol_type = other DNA
agaggattatgtgtacatggcagaatctatcccgccacctagacaacaattactctttccaagtctgtctgatgtatctattttgggaccctggtgtctaatcaaaattggcaacttccagaaggaggcttggacagtgagttgtacttaatttcagtgagtttcagctcttaacacaatagtggctgcacatcctctacccctagccctgtggcaggctttccagatgtgcatacattccagtagcagcttgtgctcaacgtgcaggggccgaatgggaaaaaatgaaccctgtcctacaaataacagggatctatgttgtgatcactgatgcctgcctctgaacacaaaggtacagacaaagaaatggcaaccatgtgtttgcaactctccctattgttgtaagcacctccccctctggctgaagtgacttccaggggatttaaagagcttgtgccttttcctgtgtctccttcatttttctccttttccctttttgggagccagacattgaagactaagacattcaaaagcaaccacatatatggggtaagttggaaagacattgaacttgcccaggggaaggtgcagcctcagaaaagacctaagaagactcttaagtgtgcagttcaggctgatccttggcaacctacaacaattacaataaacaaacaaaatccagcaaatccttgaggaagggagacaatctgatttccagagttaccatatcattagattcagatatccagttgttagcaaaaaattatgaggcataaaaagaaacaaaaacgtatggcccactcaaaggggaaaacaaagaccaacagaaacagtgcctgatgaagacctgatggcacatctactagacaaagacttttaaaaaaatcttaaagatgcttaaaaaactgaaggaaaatttggagaaagtcaagaaaatggtgtatgcattaaatgaaaatatcaaaaaagagatagaaaacataagaaagaaactaaaaagaaatgcgggagctgaaaagtacaataactgaaatgaaaattttaaaagagggattcaaaggcagatttgagcaggcagaagaaagaatcaacaaacttgtagataagacagtgaaaattatcaagtatgagaaatacaaagaaaaaaatataagaaaagtgatcagagcctaagagacatctgggttaccattaagtggaccagcttactcattgtgggagtcctaaaaggaaaagagagaagggtgcagagagaatatttgaagaaataatgatggaaaacttcccaaatttgatgaaagacatgaatataaacatccaagaagttcaatgacagctgatgaactgaaagagacccacatcgagatacactataatcaaactatccaaagtcaaagagaattttgaaaacagtgagggaaaactgatttgtctcatacaaggaattttcaataagattatgggcaaatttatcgtcagaaactttgaaggccagaagtagtggtctgatatatttaaagtgctatttttttcagctgtcaactagaaattttatacgcagaaaaaatattctccaaaagcaagggagaaattaagacattctcagataaacagaagctgaaggagttttttacttgtctttgcagtaaatgctaaagggagtccttcctgcaggttgatataaaaggacactaaacaataacttgatgccatatgaagaaaaaaagatctcagcaaagctcggtcaaggagtgtgatgactggcgagcagatggctgccttccatccatcgtccacccccaacccgctggagaggcccatcaagatgggctggctgaagaagcagaggtccatcgtgaagaactggcagcagagtggtcctccaggaagcaccaggacgggcactgtggagtttcctacacatggctctgagtcaagactggcaacagggcggtga

SEQ ID NO: 7933 - DNA, 3076 bp, synthetic construct
  misc_feature 1..3076: note = Synthetic polypeptide
  source 1..3076: mol_type = other DNA
agaggattatgtgtacatggcagaatctatcccgccacctagacaacaattactctttccaagtctgtctgatgtatctattttgggaccctggtgtctaatcaaaattggcaacttccagaaggaggcttggacagtgagttgtacttaatttcagtgagtttcagctcttaacacaatagtggctgcacatcctctacccctagccctgtggcaggctttccagatgtgcatacattccagtagcagcttgtgctcaacgtgcaggggccgaatgggaaaaaatgaaccctgtcctacaaataacagggatctatgttgtgatcactgatgcctgcctctgaacacaaaggtacagacaaagaaatggcaaccatgtgtttgcaactctccctattgttgtaagcacctccccctctggctgaagtgacttccaggggatttaaagagcttgtgccttttcctgtgtctccttcatttttctccttttccctttttgggagccagacattgaagactaagacattcaaaagcaaccacatatatggggtaagttggaaagacattgaacttgcccaggggaaggtgcagcctcagaaaagacctaagaagactcttaagtgtgcagttcaggctgatccttggcaacctacaacaattacaataaacaaacaaaatccagcaaatccttgaggaagggagacaatctgatttccagagttaccatatcattagattcagatatccagttgttagcaaaaaattatgaggcataaaaagaaacaaaaacgtatggcccactcaaaggggaaaacaaagaccaacagaaacagtgcctgatgaagacctgatggcacatctactagacaaagacttttaaaaaaatcttaaagatgcttaaaaaactgaaggaaaatttggagaaagtcaagaaaatggtgtatgcattaaatgaaaatatcaaaaaagagatagaaaacataagaaagaaactaaaaagaaatgcgggagctgaaaagtacaataactgaaatgaaaattttaaaagagggattcaaaggcagatttgagcaggcagaagaaagaatcaacaaacttgtagataagacagtgaaaattatcaagtatgagaaatacaaagaaaaaaatataagaaaagtgatcagagcctaagagacatctgggttaccattaagtggaccagcttactcattgtgggagtcctaaaaggaaaagagagaagggtgcagagagaatatttgaagaaataatgatggaaaacttcccaaatttgatgaaagacatgaatataaacatccaagaagttcaatgacagctgatgaactgaaagagacccacatcgagatacactataatcaaactatccaaagtcaaagagaattttgaaaacagtgagggaaaactgatttgtctcatacaaggaattttcaataagattatgggcaaatttatcgtcagaaactttgaaggccagaagtagtggtctgatatatttaaagtgctatttttttcagctgtcaactagaaattttatacgcagaaaaaatattctccaaaagcaagggagaaattaagacattctcagataaacagaagctgaaggagttttttacttgtctttgcagtaaatgctaaagggagtccttcctgcaggttgatataaaaggacactaaacaataacttgatgccatatgaagaaaaaaagatctcagcaaagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatggtaaggtgcagagaaccttcctgcttccattgggttcttcctttagtccaggccatcccatgtaaggcctgctctcgggtggcaatttggggagttttaggtgatgcagtggcagtgggcgctgctgctacagactcatctgaacacaccttgaaagcctggcctctttccaaatctagtttctattggcatctttga

SEQ ID NO: 7934 - DNA, 2672 bp, synthetic construct; identical to SEQ ID NO: 6621
  misc_feature 1..2672: note = Synthetic polypeptide
  source 1..2672: mol_type = other DNA

SEQ ID NO: 7935 - DNA, 1767 bp, synthetic construct; identical to SEQ ID NO: 6622
  misc_feature 1..1767: note = Synthetic polypeptide
  source 1..1767: mol_type = other DNA

SEQ ID NO: 7936 - DNA, 1692 bp, synthetic construct; identical to SEQ ID NO: 6623
  misc_feature 1..1692: note = Synthetic polypeptide
  source 1..1692: mol_type = other DNA

SEQ ID NO: 7937 - DNA, 2448 bp, synthetic construct; identical to SEQ ID NO: 6618
  misc_feature 1..2448: note = Synthetic polypeptide
  source 1..2448: mol_type = other DNA

SEQ ID NO: 7938 - DNA, 1543 bp, synthetic construct; identical to SEQ ID NO: 6619
  misc_feature 1..1543: note = Synthetic polypeptide
  source 1..1543: mol_type = other DNA

SEQ ID NO: 7939 - DNA, 1468 bp, synthetic construct; identical to SEQ ID NO: 6620
  misc_feature 1..1468: note = Synthetic polypeptide
  source 1..1468: mol_type = other DNA

SEQ ID NO: 7940 - DNA, 1848 bp, synthetic construct
  misc_feature 1..1848: note = Synthetic polypeptide
  source 1..1848: mol_type = other DNA
gatataatagaagaaaattttcctgatatgagggaagaactaactttgcagatcaaaaggggacaatgtgtacaacaggaaaaattgatacatcataatgggaataggcacttagttaaattaattgaacttcaaatataaagagttgtgcatagacagaaaaatcaagaagtacaaacttaagcttgcctcagacttttcaataggaacatctaacaccaggaaacagtggagcagtatcattgagagaatggaaatgtaaacaaagaatattgcatccagccaagttaatactcaagtacaaaggcaacaggcagacatccttaaatacaaatgaaatcataagctgttcttgtaaaatcaagttaacgaaatttatccaagcaagatagaagttcaaataaacacgcagatggaagaaggcataataaaggtctcttgttgaggtttcaatccattttatatccagaatgaagactaaaaatttggcaattataaccacagaacagattggaaaattgaaattttaaccaagtaaaaatagtaatataatctgcaaaaaccaggaggtgggattgagagcaagaagatccttataggaagaaaaagcttcaggagaaaagagaaggaaatttacaaaatttaaattggagtaaaagtcgaacatgtagaaagaacaagaaaaggggtgttgctccagtctcaaggcctcctgaacagagtgatctaaagcttgtgtgcagtgactttgagaggtctgagctgagcagtgacatcaatgtaagaagctggtgtatacaggaaagcactagggaggtttgtaaagcagatgccgaaattgcaagcagtttacctgctgcccagagagaggcagaaggttactaccagaagcctgagaagaaatgtgtggacaagttctgctccgattccagctctgactgtgggagctcctctggcagcgtgcgtgccagccggggcagctgggggagctggagcagcaccagcagctccgacggggataagaagcccatggtggacgcccagcacttcctgccggccggagacagtgtttcacaaaatgattttccttctgaagctcccatctccttgaatctttctcataacatctgcaatcccatgaccgtgaatagtctcccacaatacgcagagccttcctgtcccagccttcctgccgggcccacaggtgttgaagaagataaaggtctttactcacctggagacctgtggcccactccgccagtgtgtgtgacaagcagcttaaactgcaccctggagaacggcgtgccttgtgtgattcaggagtcggccccggttcataatagtttcattgattggagtgcaacatgcgaaggccagttttccagcgcatactgtccattggaattgaacgattacaatgcctttccagaagaaaacatgaactatgccaatggcttcccctgtcctgcagatgttcagacagactttattgatcacaactctcagtctacctggaacaccccacccaacatgcctgctgcctggggacatgccagtttcatcagctctccgccctacctcacaagcacccgaagcttgtctccaatgtctggactttttggttccatctgggccccgcaaagcgatgtgtatgaaaattgctgccccatcaaccccaccacggaacattcgacccacatggaaaaccaagcggtcgtgtgcaaggaatactacccggggttcaacccgtttcgcgcctatatgaacctggacatatggactaccacagcgaataggaatgcaaatttcccactgtctagagactcgagttactgtgggaatgtgtga

SEQ ID NO: 7941 - DNA, 382 bp, synthetic construct; identical to SEQ ID NO: 434
  misc_feature 1..382: note = Synthetic polypeptide
  source 1..382: mol_type = other DNA

SEQ ID NO: 7942 - DNA, 187 bp, synthetic construct
  misc_feature 1..187: note = Synthetic polypeptide
  source 1..187: mol_type = other DNA
ggtgctgtggagacagtatggacttcggcgtcatccagagctgagagttcccacagtctgattctgcctttatatggaatctgaatttctgtgtttggaatttgatgaggtcaaagtcaaccaaattctgaagacgctgtcagaggtagaagaaagtatcagcacactgatcagccagcctaactga

SEQ ID NO: 7943 - DNA, 629 bp, synthetic construct
  misc_feature 1..629: note = Synthetic polypeptide
  source 1..629: mol_type = other DNA
acaccacgaagaagcagttaaatacagaaggtaccaaagataatactaagagatgtaatctcagagaaaaaatttccaaatacatggacagagcggaaaacataaagaagtacttggaccaagaaaaagaagatggaaaatatcacaagcaaattaaaatagaagagaatgcaacaggtttcagttatgagtcactttttcgcgaataccttaatgagacagttacagaagtttggatagaagatccttatattagacatactcatcagctgtataactttcttcgattttgtgagatgcttattaagagaccatgtaaagtaaaaactattcaccttctcacctctctggatgaaggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacagagtcgtttttcccttggatattgtgattttgatttaagaccatgtcatgaaacaacagtagacatttttcataagaagcatacaaaaaatatatga

SEQ ID NO: 7944 - DNA, 472 bp, synthetic construct
  misc_feature 1..472: note = Synthetic polypeptide
  source 1..472: mol_type = other DNA
acaccacgaagaagcagttaaatacagaaggtaccaaagataatactaagagatgtaatctcagagaaaaaatttccaaatacatggacagagcggaaaacataaagaagtacttggaccaagaaaaagaagatggaaaatatcacaagcaaattaaaatagaagagaatgcaacaggtttcagttatgagtcactttttcgcgaataccttaatgagacagttacagaagtttggatagaagatccttatattagacatactcatcagggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacagagtcgtttttcccttggatattgtga

SEQ ID NO: 7945 - DNA, 559 bp, synthetic construct
  misc_feature 1..559: note = Synthetic polypeptide
  source 1..559: mol_type = other DNA
cactgtggttagggcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtga

SEQ ID NO: 7946 - DNA, 622 bp, synthetic construct
  misc_feature 1..622: note = Synthetic polypeptide
  source 1..622: mol_type = other DNA
cactgtggttagggcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagctgctgctacagctgaggcctggatcccggcctttccctgtgacttacgtgtctgtcaccggcaggcagccctacaaatcctggtga

SEQ ID NO: 7947 - DNA, 429 bp, synthetic construct
  misc_feature 1..429: note = Synthetic polypeptide
  source 1..429: mol_type = other DNA
cactgtggttagggcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgc

SEQ ID NO: 7948 - DNA, 377 bp, synthetic construct
  misc_feature 1..377: note = Synthetic polypeptide
  source 1..377: mol_type = other DNA
cactgtggttagggcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtt

SEQ ID NO: 7949 - DNA, 176 bp, synthetic construct
  misc_feature 1..176: note = Synthetic polypeptide
  source 1..176: mol_type = other DNA
cactgtggttagggcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactccc

SEQ ID NO: 7950 - DNA, 2333 bp, synthetic construct
  misc_feature 1..2333: note = Synthetic polypeptide
  source 1..2333: mol_type = other DNA
catttagactcacaagactactgtaggctacacttggcagcagtctcctcggaaggatatgggatagggaccacagcagggtagcatcaggcaggtgtcttctgtgggagccctttcagcagtcatgcagtaattcagagttctcttcttcagcccgccagagacagctcaggtgcaaggagatgagactatacatcaggcaggtgaccttagagcaagactccagaatgaaattcctaaagcttttaggatacagtaaagatgagcttcagaagaaggtggccacatggttgaagagtgacgtggggctaggtgagagtcctcagcccaagggaaatgacctcaacagtgacagacaacaggccttctgcagccaggcctccaaacacaccacaaaggaagcctctgcttcctcagccttctttgatgagctggtccctcagaacatgactccttgggagatccccatcacaaaagatattgatggactcctaagccaggctctcctgcttggggaactgggtccggccgtggagctgtgtctgaaggaggagcgctttgctgatgccattatcctggcccaggctgggggtacagatctgctgaagcaaacacaggagcgctacttggccaagaagaaaaccaaaatctcctcgcttctagcctgtgttgtgcaaaagaattggaaggatgtggtgtgtacctgtagcctgaagaactggagagaggcactggctttgctactgacatactcaggcacagagaaatttcccgagctctgtgacatgctgggaactcgcatggaacaggagggcagcagggcactaacctccgaagccagactctgttatgtgtgctcagggagtgtggagcggctggtggagtgctgggcaaaatgccaccaggctttgtcccccatggctctgcaggacctgatggagaaggtgatggttcttaacaggagcttggagcaactgcggggtcctcatggggtgagcccaggccctgccacaacctacagggtcactcagtatgccaacctcctggcagcccagggcagcctggccactgccatgagctttctacccagggactgtgctcagccaccagttcagcagctaagagatcggctttttcatgctcaaggttctgctgtcttgggccaacagtctccccctttccccttcccccggattgttgtgggagctaccctccactctaaagagacatcatcttacagattgggatcccagccttctcaccaggtcccaactccatctccaaggccaagggttttcacccctcagtcatcaccagcgatgcccttggcaccttcccatcctagcccttatcagggtcccaggacacagaatataagtgactacagggcacctgggccccaggccatccagcctttgcctttgagccctggggtaaggcctgcttcatctcagccacagctattaggagggcaaagggtgcaagttcctaacccggtgggattccctgggacatggcctcttcctggttcccctctacccatggcatgcccaggcatcatgcgacctggctctacctccctgcctgagactcctagactgttccctctgcttcctctgagaccactaggtcccggccgcatggtctcccacaccccagcccctcctgcaagcttccctgtgccataccttccaggggacccaggtgccccatgctctagtgtcctcccaaccactggcatcttgactcctcacccaggacctcaagattcctggaaagaagccccagcccccaggggaaacctccagaggaacaagctgccagagacatttatgcccccagcaccaattactgctccagttatgagcctcacccctgagctacaagggattcttccctcacagccccctgtctccagtgtgagtcatgctcccccaggagttccaggagaactcagcctgcagcttcagcacctgccacctgagaagatggaaaggaaggagctgcccccagagcatcagtccttgaagagcagctttgaggcgcttctccaacgctgctccctgtctgcaactgacttaaagacaaaaaggaagctggaagaggcagcccagcgtctggagtatctatatgagaagctctgtgaggggacactctcacctcatgtcgtggctgggctccatgaggttgcccgatgtgtggatgcaggaagctttgagcagggccttgcagtgcatgcccaggtggcgggctgtagcagcttcagcgaggtgtccagcttcatgcctatcctgaaggctgtcctcatcatcgctcataagctgctggtctaa

SEQ ID NO: 7951 - DNA, 361 bp, synthetic construct
  misc_feature 1..361: note = Synthetic polypeptide
  source 1..361: mol_type = other DNA
ggccgggccctgtggctcactcctgtaatcccagcactttgggaggctgaggcaggcggatcacgagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaa

SEQ ID NO: 7952 - DNA, 340 bp, synthetic construct
  misc_feature 1..340: note = Synthetic polypeptide
  source 1..340: mol_type = other DNA
ggccgggccctgtggctcactcctgtaatcccagcactttgggaggctgaggcaggcggatcacgagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggtaataggtcaacattttatcatggaaaggttcagccacagtgagagtggattttag

SEQ ID NO: 7953 - DNA, 393 bp, synthetic construct
  misc_feature 1..393: note = Synthetic polypeptide
  source 1..393: mol_type = other DNA
ggccgggccctgtggctcactcctgtaatcccagcactttgggaggctgaggcaggcggatcacgaggtcaggagatcgagaccatcctggctgacacgaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaa

SEQ ID NO: 7954 - DNA, 372 bp, synthetic construct
  misc_feature 1..372: note = Synthetic polypeptide
  source 1..372: mol_type = other DNA
ggccgggccctgtggctcactcctgtaatcccagcactttgggaggctgaggcaggcggatcacgaggtcaggagatcgagaccatcctggctgacacgaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggtaataggtcaacattttatcatggaaaggttcagccacagtgagagtggattttag

SEQ ID NO: 7955 - DNA, 956 bp, synthetic construct; identical to SEQ ID NO: 7135
  misc_feature 1..956: note = Synthetic polypeptide
  source 1..956: mol_type = other DNA

SEQ ID NO: 7956 - DNA, 1360 bp, synthetic construct
  misc_feature 1..1360: note = Synthetic polypeptide
  source 1..1360: mol_type = other DNA
ctggttcttttccttccagatccctaaagaagtggctgacatctttaacgcccccagtgatgatgaagagtttgttggcttccgagatgatgttcccatggaaaccctctcgtcagaggagagctgcgatagttttgactcactagagtcagggaaacagcaggatgtgcgctttcattccaaatacttcacagaagagctaagaagaatttttatagaggacactgactcagagactgaggattttgcaggatttacgcagagtgatctgaatggaaagactaacccagaagtaatggtcgtggagtcagatttgagtgatgatggcaaagcatctttggtgagcgaggaagaggaagatgaagaagaagataaggctacccctagaagaagcaggtctagaagaagtagtattggtcttcgagtagcctttcagttccccaccaagaagctggccaacaaaccagataaaaacagttcttccgagcagttgttttctagcgcacgcttacagaatgagaaaaaaacaattcttgaaagaaagaaagactgtagacaggtgatacaaagggaagattctacctctgagtctgaggatgactctcgggatgagagccaggagagttcagatgctttgctgaaaaggaccatgaacatcaaggagaacaaagccatgcttgcccagttattggcggaattgaactcgatgccagatttcttcccagtacgaaccccaacctcagcttctaggaagaagacagtgaggcgggccttctcggagggacagatcacgcggcgtatgaacccaacccggagtgcgcggcctcctgagaagtttgctctagagaacttcactgtctcagccgctaaatttgcggaagagttttacagcttccgaagaaggaagacaattggggggaaatgccgggagtacagacgacgtcaccgtatatcttcttttcggccagtggaggatatcaccgaagaggacttagaaaatgttgccataactgttcgagataaaatctatgataaagttctgggtaacacgtgccatcagtgtcgacaaaagaccatcgacaccaagacagtgtgtcggaaccagggttgctgtggtgtgcgaggacagttctgtggaccatgcctgcggaaccgctatggggaggatgtcagatcggcattgctggacccggattgggtgtgtcccccctgtcgtgggatctgcaattgcagctactgtcggaagcgtgacggccgctgtgccacaggaatcctcattcatctggccaagttttatggttatgacaatgttaaggaatatctggagagcttacaaaaggagctggtagaagacaattaa

SEQ ID NO: 7957 - DNA, 1222 bp, synthetic construct
  misc_feature 1..1222: note = Synthetic polypeptide
  source 1..1222: mol_type = other DNA
ctggttcttttccttccagatccctaaagaagtggctgacatctttaacgcccccagtgatgatgaagagtttgttggcttccgagatgatgttcccatggaaaccctctcgtcagaggagagctgcgatagttttgactcactagagtcagggaaacaggtcgtggagtcagatttgagtgatgatggcaaagcatctttggtgagcgaggaagaggaagatgaagaagaagataaggctacccctagaagaagcaggtctagaagaagtagtattggtcttcgagtagcctttcagttccccaccaagaagctggccaacaaaccagataaaaacagttcttccgagcagttgttttctagcgcacgcttacagaatgagaaaaaaacaattcttgaaagaaagaaagactgtagacaggtgatacaaagggaagattctacctctgagtctgaggatgactctcgggatgagagccaggagagttcagatgctttgctgaaaaggaccatgaacatcaaggagaacaaagccatgcttgcccagttattggcggaattgaactcgatgccagatttcttcccagtacgaaccccaacctcagcttctaggaagaagacagtgaggcgggccttctcggagggacagatcacgcggcgtatgaacccaacccggagtgcgcggcctcctgagaagtttgctctagagaacttcactgtctcagccgctaaatttgcggaagagttttacagcttccgaagaaggaagacaattggggggaaatgccgggagtacagacgacgtcaccgtatatcttcttttcggccagtggaggatatcaccgaagaggacttagaaaatgttgccataactgttcgagataaaatctatgataaagttctgggtaacacgtgccatcagtgtcgacaaaagaccatcgacaccaagacagtgtgtcggaaccagggttgctgtggtgtgcgaggacagttctgtggaccatgcctgcggaaccgctatggggaggatgtcagatcggcattgctggacccggattgggtgtgtcccccctgtcgtgggatctgcaattgcagctactgtcggaagcgtgacggccgctgtgccacaggaatcctcattcatctggccaagttttatggttatgacaatgttaaggaatatctggagagcttacaaaaggagctggtagaagacaattaa

SEQ ID NO: 7958 - DNA, 527 bp, synthetic construct
  misc_feature 1..527: note = Synthetic polypeptide
  source 1..527: mol_type = other DNA
caagttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactgaatttcctgttgagatataaaggcccatctgatcactggattgggctgagcagagaacaaggccaaccatggaaatggataaatggtactgaatggacaagacagttagtcatgaaagaagatggtgccaacttgtatgttgcaaaggtttcacaagttcctcgaatgaatccaagacctgtcatggtttcctatcctgggagcaggagagtgtgcctatttgaatga

SEQ ID NO: 7959 - DNA, 518 bp, synthetic construct
  misc_feature 1..518: note = Synthetic polypeptide
  source 1..518: mol_type = other DNA
caagttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactgaatttcctgttgagatataaaggcccatctgatcactggattgggctgagcagagaacaaggccaaccatggaaatggataaatggtactgaatggacaagacagtttcctatcctgggagcaggagagtgtgcctatttgaatgacaaaggtgccagtagtgccaggcactacacagagaggaagtggatttgttccaaatcagatatacatgtctag

SEQ ID NO: 7960 - DNA, 311 bp, synthetic construct
  misc_feature 1..311: note = Synthetic polypeptide
  source 1..311: mol_type = other DNA
caagttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactggtaagaaaatag

SEQ ID NO: 7961 - DNA, 45 bp, synthetic construct
  misc_feature 1..45: note = Synthetic polypeptide
  source 1..45: mol_type = other DNA
caagttgtctgcattcaaaagagcattctattaaagctaccttaa

SEQ ID NO: 7962 - DNA, 407 bp, synthetic construct
  misc_feature 1..407: note = Synthetic polypeptide
  source 1..407: mol_type = other DNA
caagttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactgaatttcctgttgagatataaaggcccatctgatcactggattgggctgagcagagaacaaggccaaccatggaaatggataaatggtactgaatggacaagacagtaa

SEQ ID NO: 7963 - DNA, 341 bp, synthetic construct
  misc_feature 1..341: note = Synthetic polypeptide
  source 1..341: mol_type = other DNA
caagttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactggtttcctatcctgggagcaggagagtgtgcctatttgaatga

SEQ ID NO: 7964 - DNA, 854 bp, synthetic construct
  misc_feature 1..854: note = Synthetic polypeptide
  source 1..854: mol_type = other DNA
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtgagtgaaccatggtgaagtggatcctccagccgtagttaaatctccagatgactacagccccagccaacatcttgactgcaacctcataaaacactgtgagcagaaatcatccaactaagctgctcccagattcctgacccacaaaaactacagtaggtcctcggcagcctgatcttctgcttcggcatctggatcctcattgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagaaagacacaccgacctggaccaagggagacaggcataaacagctccaaagggaaacacacgggaaaaagagagaacaagagaaagaaatagacgccctgaaagaagagacagagacttatgagccgtag

SEQ ID NO: 7965 - DNA, 749 bp, synthetic construct
  misc_feature 1..749: note = Synthetic polypeptide
  source 1..749: mol_type = other DNA
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtgagtgaaccatggtgaagtggatcctccagccgtagttaaatctccagatgactacagccccagccaacatcttgactgcaacctcataaaacactgtgagcagaaatcatccaactaagctgctcccagattcctgacccacaaaaactacagtaggtcctcggcagcctgatcttctgcttcggcatctggatcctcattgacaagaccagcttcgtgtcctttgcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtag

SEQ ID NO: 7966 - DNA, 1229 bp, synthetic construct
  misc_feature 1..1229: note = Synthetic polypeptide
  source 1..1229: mol_type = other DNA
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtgagtgaaccatggtgaagtggatcctccagccgtagttaaatctccagatgactacagccccagccaacatcttgactgcaacctcataaaacactgtgagcagaaatcatccaactaagctgctcccagattcctgacccacaaaaactacagtaggtcctcggcagcctgatcttctgcttcggcatctggatcctcattgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttag

SEQ ID NO: 7967 - DNA, 1196 bp, synthetic construct
  misc_feature 1..1196: note = Synthetic polypeptide
  source 1..1196: mol_type = other DNA
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtgagtgaaccatggtgaagtggatcctccagccgtagttaaatctccagatgactacagccccagccaacatcttgactgcaacctcataaaacactgtgagcagaaatcatccaactaagctgctcccagattcctgacccacaaaaactacagtaggtcctcggcagcctgatcttctgcttcggcatctggatcctcattgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgaggtgatctggccccgcccccacccgcgatcggccctaaatccctag

SEQ ID NO: 7968 - DNA, 865 bp, synthetic construct
  misc_feature 1..865: note = Synthetic polypeptide
  source 1..865: mol_type = other DNA
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtgagtgaaccatggtgaagtggatcctccagccgtagttaaatctccagatgactacagccccagccaacatcttgactgcaacctcataaaacactgtgagcagaaatcatccaactaagctgctcccagattcctgacccacaaaaactacagtaggtcctcggcagcctgatcttctgcttcggcatctggatcctcattgacaagaccagcttcgtgtcctttgtgggcaggctacaggctcccatccactgctcaccggaggcttcttggagcctgagtcttcttccggcaaatggggttgtgcatacaaacaacaatgatcatgagagccatttctcaagcacttcctatctgtcgggacttgtggctggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggc

SEQ ID NO: 7969 - DNA, 1271 bp, synthetic construct
  misc_feature 1..1271: note = Synthetic polypeptide
  source 1..1271: mol_type = other DNA
gaaagtcagaatttgtatcttgtctgtgcttgttatgagctaggtaacctaggaaggagcgatatatagttatcagcaaagtagatgaagaagaacgcaaaagaagagagcagcagaaacatgccaaagaacaggaggagctgaatgatgctgtgggattttctagagtcattcacgccattgctaattcgggaaaacttgttattggacacaatatgctcttggacgtcatgcacacagttcatcagttctactgccctctgcctgcggacttaagtgagtttaaagagatgacaacatgtgttttccccagactcttggatactaaattgatggccagcacacaaccttttaaggatatcattaacaacacatcccttgcggaattggaaaagcggttaaaagagacacctttcaaccctcctaaagttgaaagtgccgaaggttttccaagttatgacacagcctctgaacaactccacgaggcaggctacgatgcctacatcacagggctgtgcttcatctccatggccaattacctaggttcttttctcagccctccaaaaattcatgtgtctgccagatcaaaactcattgaacctttttttaacaagttatttcttatgagggtcatggatatcccctatctaaacttggaaggaccagacttgcagcctaaacgtgatcatgttctccatgtgacattccccaaagaatggaaaaccagcgacctttaccagcttttcagtgcctttggtaacattcagatatcctggattgatgacacatcagcatttgtttcccttagccagcccgagcaagtaaagattgctgtcaataccagcaaatatgcagaaagctatcggatccaaacctatgctgaatatatggggagaaaacaggaagagaagcagatcaaaagaaagtggactgaagatagctggaaggaggctgacagcaaacggttaaacccccagtgcataccctacaccctgcagaatcactattaccgcaacaatagttttacagctcccagcacagtaggaaagagaaatttgagtcctagtcaagaggaagctggcctggaggacggagtgtcaggggagatttccgacactgagcttgagcagaccgattcctgtgcagagcccctctcagagggaaggaaaaaggccaagaaattaaaaagaatgaagaaggagctttctccagcaggaagcatctcgaagaacagccctgccacactctttgaagttcctgacacatggtaa

SEQ ID NO: 7970 - DNA, 69 bp, synthetic construct
  misc_feature 1..69: note = Synthetic polypeptide
  source 1..69: mol_type = other DNA
gaaagtcagaatttgtatcttgtctgtgcttgttatgagctaggtaacctaggaaggagcgatatatag

SEQ ID NO: 7971 - DNA, 738 bp, synthetic construct
  misc_feature 1..738: note = Synthetic polypeptide
  source 1..738: mol_type = other DNA
ctcaacactgcatggcttcccttagaacctttgcccaattctgaagctgtgggtggaagatgagaagccacacagagagcctccgaataacataggagcctcttggccatcttgaggtgctgatgagatgaggatcggcctgaccctcgagcccagcagagcagggcagcccagaagcagatgacactgtcccaaatgtgtggccaccctggagtcagctcagtccctgcacggtccaggggatccccctctactcggtctgcctggcggagcaaagggtgagccctctagaggaaaatgtcgccatcctagacctctgcagtctttcctatgcgttcagcaacagtttaccgggcatgccacgagacaggaccacagcaccgaaaaccacgagaaaaaaagagcagtagagccacagtgggagaggccgatgttatcagataaggagcctaaaataaggggaaaaaggaaaaattggagcatttcgccagagatgcagcttcagctgccctcgcagatgccgctgaggagctgctggaccgccttgcgtcacacagcatgctgccctcagacgtgtccatcctgtaccacatgaaaacgctgctgctcctgcaagatactgagagattgaagcatgctctggaaatgttcccagaacattgcacgatgcctcctggagtcctaagcagacttaaagccaagaaaataagaagaggaaagagagaggggctgccttaa

SEQ ID NO: 7972 - DNA, 816 bp, synthetic construct
  misc_feature 1..816: note = Synthetic polypeptide
  source 1..816: mol_type = other DNA
ctcaacactgcatggcttcccttagaacctttgcccaattctgaagctgtgggtggaagatgagaagccacacagagagcctccgaataacataggagcctcttggccatcttgaggtgctgatgagatgaggatcggcctgaccctcgagcccagcagagcagggcagcccagaagcagatgacactgtcccaaatgtgtggccaccctggagtcagctcagtccctgcacggtccaggggatccccctctactcggtctgcctggcggagcaaagggtgagccctctagaggaaaatgtcgccatcctagacctctgcagtctttcctatgcgttcagcaacagtttaccgggcatgccacgagacaggaccacagcaccgaaaaccacgagaaaaaaagagcagtagagccacagtgggagaggccgatgttatcagataaggagcctaaaataaggggaaaaaggaaaaattggagcatttcgccagagatgcagcttcagctgccctcgcagatgccgctgaggagctgctggaccgccttgcgtcacacagcatgctgccctcagacgtgtccatcctgtaccacatgaaaacgctgctgctcctgcaagatactgagagattgaagcatgctctggaaatgttcccagaacattgcacgatgcctcctggtgggaagtctgaagctcagagagcctgggccaatggtacaggtcacacagcacatcagtggctacatgtgagctcagacctgggtctgctgctgtctgtcttcccaatatccatgaccttgactgatgcaggtgtctag

SEQ ID NO: 7973 - DNA, 750 bp, synthetic construct
  misc_feature 1..750: note = Synthetic polypeptide
  source 1..750: mol_type = other DNA
ctcaacactgcatggcttcccttagaacctttgcccaattctgaagctgtgggtggaagatgagaagccacacagagagcctccgaataacataggagcctcttggccatcttgaggtgctgatgagatgaggatcggcctgaccctcgagcccagcagagcagggcagcccagaagcagatgacactgtcccaaatgtgtggccaccctggagtcagctcagtccctgcacggtccaggggatccccctctactcggtctgcctggcggagcaaagggtgagccctctagaggaaaatgtcgccatcctagacctctgcagtctttcctatgcgttcagcaacagtttaccgggcatgccacgagacaggaccacagcaccgaaaaccacgagaaaaaaagagcagtagagccacagtgggagaggccgatgttatcagataaggagcctaaaataaggggaaaaaggaaaaattggagcatttcgccagagatgcagcttcagctgccctcgcagatgccgctgaggagctgctggaccgccttgcgtcacacagcatgctgccctcagacgtgtccatcctgtaccacatgaaaacgctgctgctcctgcaagatactgagagattgaagcatgctctggaaatgttcccagaacattgcacgatgcctcctgaccatgccagagtaatctcagctttctttagttactggatcacacatatccttcctgagaagagcagtgactaa

SEQ ID NO: 7974 - DNA, 783 bp, synthetic construct
  misc_feature 1..783: note = Synthetic polypeptide
  source 1..783: mol_type = other DNA
ctcaacactgcatggcttcccttagaacctttgcccaattctgaagctgtgggtggaagatgagaagccacacagagagcctccgaataacataggagcctcttggccatcttgaggtgctgatgagatgaggatcggcctgaccctcgagcccagcagagcagggcagcccagaagcagatgacactgtcccaaatgtgtggccaccctggagtcagctcagtccctgcacggtccaggggatccccctctactcggtctgcctggcggagcaaagggtgagccctctagaggaaaatgtcgccatcctagacctctgcagtctttcctatgcgttcagcaacagtttaccgggcatgccacgagacaggaccacagcaccgaaaaccacgagaaaaaaagagcagtagagccacagtgggagaggccgatgttatcagataaggagcctaaaataaggggaaaaaggaaaaattggagcatttcgccagagatgcagcttcagctgccctcgcagatgccgctgaggagctgctggaccgccttgcgtcacacagcatgctgccctcagacgtgtccatcctgtaccacatgaaaacgctgctgctcctgcaagatactgagagattgaagcatgctctggaaatgttcccagaacattgcacgatgcctcctggtaagtaccgtacgatttattcaaggtcctgcttaagatactctcatcgaggtttgcctctgaaagacttacacgccaccaaaacagcaatgagttggaaaatatga

SEQ ID NO: 7975 - DNA, 3050 bp, synthetic construct
  misc_feature 1..3050: note = Synthetic polypeptide
  source 1..3050: mol_type = other DNA
tgacatggtttggctgtgtccctacccaaatctcatcttgaatcgtagttctcataatccccacgtgtcatgggagggacctagggggaggtaatttaatcatggggacagttaccctcatgctgttcttgtgacagtgggtgagttctcacgagatctgacagttttatgaggggcttttccctgcttcactctgcacttctcctcgccgccgccatatgaaggacgtgtttgcttccccttctgccgtaattgtaagtttcctgaggcctccccagccatgctgaactatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttctgcctgcagtgcccaggagcttgtgaagctgctcaacgagctctttgcccgctttgacaagctggcagctaaataccaccagctgcggattaagatcctgggcgactgctactactgcatctgcggcttgcccgactaccgggaggaccacgccgtctgctccatcctcatggggctggccatggtggaggccatctcgtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggccctgcccaatggagcaccagcttcctcaaagtccagctcccctgccctcattgagaccaaggagcccaacgggagtgcccacagcagtgggtccacgtcggagaagcccgaggagcaggatgcccaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggctaatgacaaactatgtgaccttcatggtgggggagattctgctcctcatcctgaccatctgctccctggctgccatctttccccgggcctttcctaagaagcttgtggccttctcaacttggattgaccggacccgctgggccaggaacacctgggccatgctcgccatcttcatcctggtgatggcaaatgtcgtggacatgctcagctgtctccagtactacacgggacccagcaatgcaacggcagggatggaaacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgacttacctatggtggccttagagcagatgcaaggattcaaccctgggctcaatggcactgacaggctgcccctggtgccttccaagtactctatgacggtgatggtgttcctcatgatgctcagcttctactacttctcccgccacgtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggagctgtatagccagacgtatgatgagattggagtcatgtttgcctccctgcccaactttgctgacttctacacagaggagagcatcaacaatggtggtattgagtgtctgcgtttcctcaatgaaatcatctcagattttgactctctcctggacaatcccaagttccgggtgatcaccaagatcaaaaccattggcagcacgtatatggcggcttcaggagtcacccccgatgtcaacaccaatggctttgccagctccaacaaggaagacaagtccgagagagagcgctggcagcacctggctgacctggccgacttcgcgctggccatgaaggatacgctcaccaacatcaacaaccagtccttcaataacttcatgctgcgcataggcatgaacaaaggcggggttctggctggggtcatcggagcccggaaaccacactacgacatctggggcaatacagtcaatgtagccagcaggatggagtccacgggggtcatgggcaacattcaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctga

SEQ ID NO: 7976 - DNA, 745 bp, synthetic construct
  misc_feature 1..745: note = Synthetic polypeptide
  source 1..745: mol_type = other DNA
tgacatggtttggctgtgtccctacccaaatctcatcttgaatcgtagttctcataatccccacgtgtcatgggagggacctagggggaggtaatttaatcatggggacagttaccctcatgctgttcttgtgacagtgggtgagttctcacgagatctgacagttttatgaggggcttttccctgcttcactctgcacttctcctcgccgccgccatatgaaggacgtgtttgcttccccttctgccgtaattgtaagtttcctgaggcctccccagccatgctgaactatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttctgcctgcagtgcccaggagcttgtgaagctgctcaacgagctctttgcccgctttgacaagctggcagctaaataccaccagctgcggattaagatcctgggcgactgctactactgcatctgcggcttgcc

SEQ ID NO: 7977 - DNA, 362 bp, synthetic construct
  misc_feature 1..362: note = Synthetic polypeptide
  source 1..362: mol_type = other DNA
gagcacgaggtaagactcggaccaaggacaagtaccgcgtggtctacaccgaccaccaacgcctggagctggagaaggagtttcattacagccgttacatcacaatccggcggaaatcagagctggctgccaatctggggctcactgaacggcaggtgaagatctggttccaaaaccggcgggcaaaggagcgcaaagtgaacaagaagaaacagcagcagcaacagcccccacagccgccgatggcccacgacatcacggccaccccagccgggccatccctggggggcctgtgtcccagcaacaccagcctcctggccacctcctctccaatgcctgtgaaagaggagtttctgccatag

SEQ ID NO: 7978 - DNA, 254 bp, synthetic construct; identical to SEQ ID NO: 6870
  misc_feature 1..254: note = Synthetic polypeptide
  source 1..254: mol_type = other DNA

SEQ ID NO: 7979 - DNA, 415 bp, synthetic construct; identical to SEQ ID NO: 6871
  misc_feature 1..415: note = Synthetic polypeptide
  source 1..415: mol_type = other DNA

SEQ ID NO: 7980 - DNA, 580 bp, synthetic construct; identical to SEQ ID NO: 6872
  misc_feature 1..580: note = Synthetic polypeptide
  source 1..580: mol_type = other DNA

SEQ ID NO: 7981 - DNA, 1249 bp, synthetic construct
  misc_feature 1..1249: note = Synthetic polypeptide
  source 1..1249: mol_type = other DNA
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccagttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataa

SEQ ID NO: 7982 - DNA, 472 bp, synthetic construct
  misc_feature 1..472: note = Synthetic polypeptide
  source 1..472: mol_type = other DNA
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccagttcaaggagcagggacaagttacaggaatgttctccaagcagcaatccaaaagagtctcaaggatccttcaaataacttcaggatgataacaccctatgcccattgtcctgatctgaaaattcttggaaattgttccatgtga

SEQ ID NO: 7983 - DNA, 1195 bp, synthetic construct
  misc_feature 1..1195: note = Synthetic polypeptide
  source 1..1195: mol_type = other DNA
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccagttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagggggacaattcccggaagtggaattacagagtcaaaggacatgcatttttcaagcctcggatgcatcttactagatgtcctatag

SEQ ID NO: 7984 - DNA, 709 bp, synthetic construct
  misc_feature 1..709: note = Synthetic polypeptide
  source 1..709: mol_type = other DNA
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccagttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagaaaacgcccactcctggatcttcacattgaactcaatggctacatgtatgattggaacagcagagtttctgccaaggagaaatattatgtctggctgcagcacactctga

SEQ ID NO: 7985 - DNA, 1144 bp, synthetic construct
  misc_feature 1..1144: note = Synthetic polypeptide
  source 1..1144: mol_type = other DNA
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccagttcaaggagcagggacaagttacaggaatgttctccaagcagcaatccaaaagagtctcaaggatccttcaaataacttcaggagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataa

SEQ ID NO: 7986 - DNA, 685 bp, synthetic construct
  misc_feature 1..685: note = Synthetic polypeptide
  source 1..685: mol_type = other DNA
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccagttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacaggttggagtgcaatggcgcaatctcagctcaccgcaatctccacctcccaggttcaagcgattctcctgcctcagcctcctgagtaa

SEQ ID NO: 7987 - DNA, 538 bp, synthetic construct
  misc_feature 1..538: note = Synthetic polypeptide
  source 1..538: mol_type = other DNA
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccagttcaaggagcagggacaagttacaggaatgttctccaagcagcaatccaaaagagtctcaaggatccttcaaataacttcagggctggagtgcaatggcgcgatcttggctcaccgcaacctccgcctcccgggttcaagcgattctcccacctcagcctcccaagtagctgggattacaggaatgtgccaccacgcccggctccataa

SEQ ID NO: 7988 - DNA, 446 bp, synthetic construct
  misc_feature 1..446: note = Synthetic polypeptide
  source 1..446: mol_type = other DNA
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccagttcaaggagcagggacaagttacaggaatgttctccaagcagcaatccaaaagagtctcaaggatccttcaaataacttcaggatgataacaccctatgcccattgtcctgatctga

SEQ ID NO: 7989 - DNA, 599 bp, synthetic construct
  misc_feature 1..599: note = Synthetic polypeptide
  source 1..599: mol_type = other DNA
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccagttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacag

SEQ ID NO: 7990 - DNA, 448 bp, synthetic construct
  misc_feature 1..448: note = Synthetic polypeptide
  source 1..448: mol_type = other DNA
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccagttcaaggagcagggacaagttacaggaatgttctccaagcagcaatccaaaagagtctcaaggatccttcaaataacttcagggtgagtctggagaaaacatatggaatcccagcatga

SEQ ID NO: 7991 - DNA, 220 bp, synthetic construct
  misc_feature 1..220: note = Synthetic polypeptide
  source 1..220: mol_type = other DNA
ttagtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctggtgacggtgtcaggacagagggtgtttgtggtgaagaggcagaaccgaggtcgggagcccattgatgtctga

SEQ ID NO: 7992 - DNA, 334 bp, synthetic construct
  misc_feature 1..334: note = Synthetic polypeptide
  source 1..334: mol_type = other DNA
ttagtcatctggggacctggagaatgatgagcaggcagccagtgccatctctgagctggtcagcacagcctgcggtttccggctgcaccgcggcatgaatgtgcccttcaagcgcctgtctggtgagcccctgcccctgcccttggtggtggtactgggagcggggggctacttccaggggcttctcggcttctcttcttccagcctcctaccatctcctggggtctctggtctggccactttcctccctttgggactccctggtatcagaattgtgaatgagaaggcaagagaaaggagatctagcagaggccactcatcttcaaatctctga

SEQ ID NO: 7993 - DNA, 287 bp, synthetic construct
  misc_feature 1..287: note = Synthetic polypeptide
  source 1..287: mol_type = other DNA
gtgaccttggataaggcacacttagcctcagctttttcctctacaagtgttgctttctcatagggcgaaattcttcagacgagatacttaagatgatgaacaatggcctcctccaacagccctctgccttgatgttgctcccctgccgcccagttcttacttctgtggcccttaatgccaactttgtgtcctggaagagtcgtaccaagtacaccattacaccagtgaagatgaggaagtctgggggccgagaccacacaggtgggaacaaggacagggggatttaa

SEQ ID NO: 7994 - DNA, 914 bp, synthetic construct
  misc_feature 1..914: note = Synthetic polypeptide
  source 1..914: mol_type = other DNA
gtgaccttggataaggcacacttagcctcagctttttcctctacaagtgttgctttctcatagggcgaaattcttcagacgagatacttaagatgatgaacaatggcctcctccaacagccctctgccttgatgttgctcccctgccgcccagttcttacttctgtggcccttaatgccaactttgtgtcctggaagagtcgtaccaagtacaccattacaccagtgaagatgaggaagtctgggggccgagaccacacaggccgaatccgggtgcatggtattggcgggggccacaagcaacgttatcgaatgattgactttctgcgtttccggcctgaggagaccaagtcaggaccctttgaggagaaggttatccaagtccgctatgatccctgtaggtcagcagacatagctctggttgctgggggcagccggaaacgctggatcatcgccacagaaaacatgcaggctggagatacaatcttgaactctaaccacataggccgaatggcagttgctgctcgggaaggggatgcgcatcctcttggggctctgcctgtggggaccctcatcaacaacgtggaaagtgagccaggccggggtgcccaatatatccgagctgcagggacgtgtggtgtgctactgcggaaggtgaatggcacagccattatccagctgccctctaagaggcagatgcaggtgctggaaacgtgcgtagcaacagtaggccgagtatccaacgttgatcataacaaacgggtcattggcaaggcaggtcgcaaccgctggctgggcaagaggcctaacagtgggcggtggcaccgcaaggggggctgggctggccgaaagattcggccactaccccccatgaagagttacgtgaagctgccttctgcttctgcccaaagctga

SEQ ID NO: 7995 - DNA, 674 bp, synthetic construct
  misc_feature 1..674: note = Synthetic polypeptide
  source 1..674: mol_type = other DNA
gtgaccttggataaggcacacttagcctcagctttttcctctacaagtgttgctttctcatagggcgaaattcttcagacgagatacttaagatgatgaacaatggcctcctccaacagccctctgccttgatgttgctcccctgccgcccagttcttacttctgtggcccttaatgccaactttgtgtcctggaagagtcgtaccaagtacaccattacaccagtgaagatgaggaagtctgggggccgagaccacacaggccgaatccgggtgcatggtattggcgggggccacaagcaacgttatcgaatgattgactttctgcgtttccggcctgaggagaccaagtcaggaccctttgaggagaaggttatccaagtccgctatgatccctgtaggtcagcagacatagctctggttgctgggggcagccggaaacgctggatcatcgccacagaaaacatgcaggctggagatacaatcttgaactctaaccacataggccgaatggcagttgctgctcgggaaggggatgcgcatcctcttggggctctgcctgtggggaccctcatcaacaacgtggaaagtgagccaggccggggtgcccaatatatccgagctgcaggtgctggaaacgtgcgtagcaacagtaggccgagtatccaacgttga

SEQ ID NO: 7996 - DNA, 308 bp, synthetic construct
  misc_feature 1..308: note = Synthetic polypeptide
  source 1..308: mol_type = other DNA
gtgaccttggataaggcacacttagcctcagctttttcctctacaagtgttgctttctcatagggcgaaattcttcagacgagatacttaagatgatgaacaatggcctcctccaacagccctctgccttgatgttgctcccctgccgcccagttcttacttctgtggcccttaatgccaactttgtgtcctggaagagtcgtaccaagtacaccattacaccagtgaagatgaggaagtctgggggccgagaccacacaggtgctggaaacgtgcgtagcaacagtaggccgagtatccaacgttga

SEQ ID NO: 7997 - DNA, 175 bp, synthetic construct
  misc_feature 1..175: note = Synthetic polypeptide
  source 1..175: mol_type = other DNA
gtgaccttggataaggcacacttagcctcagctttttcctctacaagtgttgctttctcatagggcgaaattcttcagacgagatacttaagatgatgaacaatggcctcctccaacagccctctgccttgatgttgctcccctgccgcccagttcttacttctgtggcccttaa

SEQ ID NO: 7998 - DNA, 247 bp, synthetic construct
  misc_feature 1..247: note = Synthetic polypeptide
  source 1..247: mol_type = other DNA
aatgagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaaggtacagtttactgttgcagacttttggacaaagtccttttcttggctgttataa

SEQ ID NO: 7999 - DNA, 430 bp, synthetic construct
  misc_feature 1..430: note = Synthetic polypeptide
  source 1..430: mol_type = other DNA
aatgagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataa

SEQ ID NO: 8000 - DNA, 330 bp, synthetic construct; identical to SEQ ID NO: 7604
  misc_feature 1..330: note = Synthetic polypeptide
  source 1..330: mol_type = other DNA

SEQ ID NO: 8001 - DNA, 181 bp, synthetic construct; identical to SEQ ID NO: 7564
  misc_feature 1..181: note = Synthetic polypeptide
  source 1..181: mol_type = other DNA

SEQ ID NO: 8002 - DNA, 543 bp, synthetic construct; identical to SEQ ID NO: 6496
  misc_feature 1..543: note = Synthetic polypeptide
  source 1..543: mol_type = other DNA

SEQ ID NO: 8003 - DNA, 378 bp, synthetic construct; identical to SEQ ID NO: 6497
  misc_feature 1..378: note = Synthetic polypeptide
  source 1..378: mol_type = other DNA

SEQ ID NO: 8004 - DNA, 267 bp, synthetic construct; identical to SEQ ID NO: 6498
  misc_feature 1..267: note = Synthetic polypeptide
  source 1..267: mol_type = other DNA

SEQ ID NO: 8005 - DNA, 416 bp, synthetic construct; identical to SEQ ID NO: 6499
  misc_feature 1..416: note = Synthetic polypeptide
  source 1..416: mol_type = other DNA

SEQ ID NO: 8006 - DNA, 162 bp, synthetic construct; identical to SEQ ID NO: 6500
  misc_feature 1..162: note = Synthetic polypeptide
  source 1..162: mol_type = other DNA

SEQ ID NO: 8007 - DNA, 147 bp, synthetic construct; identical to SEQ ID NO: 6327
  misc_feature 1..147: note = Synthetic polypeptide
  source 1..147: mol_type = other DNA

SEQ ID NO: 8008 - DNA, 815 bp, synthetic construct
  misc_feature 1..815: note = Synthetic polypeptide
  source 1..815: mol_type = other DNA
ttattgtccttgtccttgttgtcatcagattctaagcttcatggcactggggacttgagactcgttcagcgttttctctctagtatcttaaacagcggcaagtcatgcgtgacccgacataggtgctagggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatgccgtataggtgagggacttgatcaggctctgccctgtctgacagaactcattctcaccaataatagtctcgtggaactgggtgatctggaccctctggcatctctcaaatcgctgacttacctaagtatcctaagaaatccggtaaccaataagaagcattacagattgtatgtgatttataaagttccgcaagtcagagtactggatttccagaaagtgaaactaaaagagcgtcaggaagcagagaaaatgttcaagggcaaacggggtgcacagcttgcaaaggatattgccaggagaagcaaaacttttaatccaggtgctggtttgccaactgacaaaaagaaaggtgggccatctccaggggatgtagaagcaatcaagaatgccatagcaaatgcttcaactctggctgaagtggagaggctgaaggggttgctgcagtctggtcagatccctggcagagaacgcagatcagggcccactgatgatggtgaagaagagatggaagaagacacagtcacaaacgggtcctga

SEQ ID NO: 8009 - DNA, 512 bp, synthetic construct
  misc_feature 1..512: note = Synthetic polypeptide
  source 1..512: mol_type = other DNA
ttattgtccttgtccttgttgtcatcagattctaagcttcatggcactggggacttgagactcgttcagcgttttctctctagtatcttaaacagcggcaagtcatgcgtgacccgacataggtgctagggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatgccgtataggtgagggacttgatcaggctctgccctgtctgacagaactcattctcaccaataatagtctcgtggaactgggtgatctggaccctctggcatctctcaaatcgctgacttacctaagtatcctaagaaatccggtaaccaataagaagcattacagattgtatgtgatttataaagttccgcaagtcagagtactggatttccagaaagtgaaactaaaattttaa

SEQ ID NO: 8010 - DNA, 1543 bp, synthetic construct
  misc_feature 1..1543: note = Synthetic polypeptide
  source 1..1543: mol_type = other DNA
gagtgggcctgggaagtagaagcccccaggattcattcctgctccatcctattctagctgtgggacttggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatggctggccgatcctgctggggctgaccggggtccccgcggcgctgcagctccttctgctgcccttcttccccgagagccccaggtacctgctgattcagaagaaagacgaagcggccgccaagaaagccctacagacgctgcgcggctgggactctgtggacagggaggtggccgagatccggcaggaggatgaggcagagaaggccgcgggcttcatctccgtgctgaagctgttccggatgcgctcgctgcgctggcagctgctgtccatcatcgtcctcatgggcggccagcagctgtcgggcgtcaacgctatctactactacgcggaccagatctacctgagcgccggcgtgccggaggagcacgtgcagtacgtgacggccggcaccggggccgtgaacgtggtcatgaccttctgcgccgtgttcgtggtggagctcctgggtcggaggctgctgctgctgctgggcttctccatctgcctcatagcctgctgcgtgctcactgcagctctggcactgcaggacacagtgtcctggatgccatacatcagcatcgtctgtgtcatctcctacgtcataggacatgccctcgggcccagtcccatacccgcgctgctcatcactgagatcttcctgcagtcctctcggccatctgccttcatggtggggggcagtgtgcactggctctccaacttcaccgtgggcttgatcttcccgttcatccaggagggcctcggcccgtacagcttcattgtcttcgccgtgatctgcctcctcaccaccatctacatcttcttgattgtcccggagaccaaggccaagacgttcatagagatcaaccagattttcaccaagatgaataaggtgtctgaagtgtacccggaaaaggaggaactgaaagagcttccacctgtcacttcggaacagtga

SEQ ID NO: 8011 - DNA, 772 bp, synthetic construct
  misc_feature 1..772: note = Synthetic polypeptide
  source 1..772: mol_type = other DNA
gagtgggcctgggaagtagaagcccccaggattcattcctgctccatcctattctagctgtgggacttggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatggtgagttcaggacatctcgggagcacccccaccccttcaccactacccttggccccctccttgtgttccaaagccaccaccacaggacaggactttctgcagactggtctcttctaacaggctggatgtccttggggggcccatcctgtcccgagccaacatag

SEQ ID NO: 8012 - DNA, 608 bp, synthetic construct
  misc_feature 1..608: note = Synthetic polypeptide
  source 1..608: mol_type = other DNA
gagtgggcctgggaagtagaagcccccaggattcattcctgctccatcctattctagctgtgggacttggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatg

SEQ ID NO: 8013 - DNA, 535 bp, synthetic construct
  misc_feature 1..535: note = Synthetic polypeptide
  source 1..535: mol_type = other DNA
gagtgggcctgggaagtagaagcccccaggattcattcctgctccatcctattctagctgtgggacttggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccc

SEQ ID NO: 8014 - DNA, 454 bp, synthetic construct
  misc_feature 1..454: note = Synthetic polypeptide
  source 1..454: mol_type = other DNA
gagtgggcctgggaagtagaagcccccaggattcattcctgctccatcctattctagctgtgggacttggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgca

SEQ ID NO: 8015 - DNA, 280 bp, synthetic construct
  misc_feature 1..280: note = Synthetic polypeptide
  source 1..280: mol_type = other DNA
gagtgggcctgggaagtagaagcccccaggattcattcctgctccatcctattctagctgtgggacttggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttgga

SEQ ID NO: 8016 - DNA, 441 bp, synthetic construct
  misc_feature 1..441: note = Synthetic polypeptide
  source 1..441: mol_type = other DNA
ctgggcacggttggctcatgcttgtaatcccaacattttgggaggttgagcattggcgctctcataggcctgtccgtagcagcagtggttcttctcgccttcattgttaccgcctgtgtgctctgctacctgttcatcagctctaagccccacacaaagttggacctgggcttgagcttacagacagcaggccctgaggaggtttctcctgactgccaaggtgtgaacacaggcatggcggcagaagtgccaaaagtgagccctctccagcagagttactcctgcttgaacccgcagctggagagcaatgaggggcaggctgtgaactccaaacgcctcctccatcattgcttcatggccacagtgaccaccagtgacattccaggcagccctgaggaagcctctgtacccaaccctgacctatgtggaccagtcccataa

SEQ ID NO: 8017 - DNA, 2851 bp, synthetic construct
  misc_feature 1..2851: note = Synthetic polypeptide
  source 1..2851: mol_type = other DNA
ggccgggcacggtggctcacacctatcatcccagcactttgggaagcaaagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagggatatgtgggccactggatctttgccagacttcccagctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggcaggttcacaggctgcagcctcagccaggagcacgtagagtcactctgctggttgctgagcaagtgtaaagacctcagccaggtggatctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagggtgcaggagccgtgggcggacagagccagggttctctccctgttagaagtctgcgcccaggcctcaggcagtgtcactgaaatcagcatctccgagacccagcagcagctctgtgtccagctggaatttcctcgccaggaagagaatccagaagctgtggcactcaggttggctcactgtgaccttggagcccaccacagccttcttgtcgggcagctgatggagacatgtgccaggctgcagcagctcagcttgtctcaggttaacctctgtgaggacgatgatgccagttccctgctgctgcagagcctcctgctgtccctctctgagctgaagacatttcggctgacctccagctgtgtgagcaccgagggcctcgcccacctggcatctggtctgggccactgccaccacttggaggagctggacttgtctaacaatcaatttgatgaggagggcaccaaggcgctgatgagggcccttgaggggaaatggatgctaaagaggctggacctcagtcaccttctgctgaacagctccaccttggccttgcttactcacagactaagccagatgacctgcctgcagagcctcagactgaacaggaacagtatcggtgatgtcggttgctgccacctttctgaggctctcagggctgccaccagcctagaggagctggacttgagccacaaccagattggagacgctggtgtccagcacttagctaccatcctgcctgggctgccagagctcaggaagatagacctctcagggaatagcatcagctcagccgggggagtgcagttggcagagtctctcgttctttgcaggcgcctggaggagttgatgcttggctgcaatgccctgggggatcccacagccctggggctggctcaggagctgccccagcacctgagggtcctacacctaccattcagccatctgggcccaggtggggccctgagcctggcccaggccctggatggatccccccatttggaagagatcagcttggcggaaaacaacctggctggaggggtcctgcgtttctgtatggagctcccgctgctcagacagatagacctggtttcctgtaagattgacaaccagactgccaagctcctcacctccagcttcacgagctgccctgccctggaagtaatcttgctgtcctggaatctcctcggggatgaggcagctgccgagctggcccaggtgctgccgcagatgggccggctgaagagagtggacctggagaagaatcagatcacagctttgggggcctggctcctggctgaaggactggcccaggggtctagcatccaagtcatccgcctctggaataaccccattccctgcgacatggcccagcacctgaagagccaggagcccaggctggactttgccttctttgacaaccagccccaggccccttggggtacttga

SEQ ID NO: 8018 - DNA, 2764 bp, synthetic construct
  misc_feature 1..2764: note = Synthetic polypeptide
  source 1..2764: mol_type = other DNA
ggccgggcacggtggctcacacctatcatcccagcactttgggaagcaaagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagggatatgtgggccactggatctttgccagacttcccagctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggtctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagggtgcaggagccgtgggcggacagagccagggttctctccctgttagaagtctgcgcccaggcctcaggcagtgtcactgaaatcagcatctccgagacccagcagcagctctgtgtccagctggaatttcctcgccaggaagagaatccagaagctgtggcactcaggttggctcactgtgaccttggagcccaccacagccttcttgtcgggcagctgatggagacatgtgccaggctgcagcagctcagcttgtctcaggttaacctctgtgaggacgatgatgccagttccctgctgctgcagagcctcctgctgtccctctctgagctgaagacatttcggctgacctccagctgtgtgagcaccgagggcctcgcccacctggcatctggtctgggccactgccaccacttggaggagctggacttgtctaacaatcaatttgatgaggagggcaccaaggcgctgatgagggcccttgaggggaaatggatgctaaagaggctggacctcagtcaccttctgctgaacagctccaccttggccttgcttactcacagactaagccagatgacctgcctgcagagcctcagactgaacaggaacagtatcggtgatgtcggttgctgccacctttctgaggctctcagggctgccaccagcctagaggagctggacttgagccacaaccagattggagacgctggtgtccagcacttagctaccatcctgcctgggctgccagagctcaggaagatagacctctcagggaatagcatcagctcagccgggggagtgcagttggcagagtctctcgttctttgcaggcgcctggaggagttgatgcttggctgcaatgccctgggggatcccacagccctggggctggctcaggagctgccccagcacctgagggtcctacacctaccattcagccatctgggcccaggtggggccctgagcctggcccaggccctggatggatccccccatttggaagagatcagcttggcggaaaacaacctggctggaggggtcctgcgtttctgtatggagctcccgctgctcagacagatagacctggtttcctgtaagattgacaaccagactgccaagctcctcacctccagcttcacgagctgccctgccctggaagtaatcttgctgtcctggaatctcctcggggatgaggcagctgccgagctggcccaggtgctgccgcagatgggccggctgaagagagtggacctggagaagaatcagatcacagctttgggggcctggctcctggctgaaggactggcccaggggtctagcatccaagtcatccgcctctggaataaccccattccctgcgacatggcccagcacctgaagagccaggagcccaggctggactttgccttctttgacaaccagccccaggccccttggggtacttga

SEQ ID NO: 8019 - DNA, 1906 bp, synthetic construct
  misc_feature 1..1906: note = Synthetic polypeptide
  source 1..1906: mol_type = other DNA
ggccgggcacggtggctcacacctatcatcccagcactttgggaagcaaagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagggatatgtgggccactggatctttgccagacttcccagctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggcaggttcacaggctgcagcctcagccaggagcacgtagagtcactctgctggttgctgagcaagtgtaaagacctcagccaggtggatctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagggtgcaggagccgtgggcggacagagccagggttctctccctgttagaagtctgcgcccaggcctcaggcagtgtcactgaaatcagcatctccgagacccagcagcagctctgtgtccagctggaatttcctcgccaggaagagaatccagaagctgtggcactcaggttggctcactgtgaccttggagcccaccacagccttcttgtcgggcagctgatggagacatgtgccaggctgcagcagctcagcttgtctcaggttaacctctgtgaggacgatgatgccagttccctgctgctgcagagcctcctgctgtccctctctgagctgaagacatttcgcattcagagctcccaagacccagggcggctcctgcctgacctgttgccctttgacccccaccaggctgacctccagctgtgtgagcaccgagggcctcgcccacctggcatctggtctgggccactgccaccacttggaggagctggacttgtctaa

SEQ ID NO: 8020 - DNA, 1534 bp, synthetic construct
  misc_feature 1..1534: note = Synthetic polypeptide
  source 1..1534: mol_type = other DNA
ggccgggcacggtggctcacacctatcatcccagcactttgggaagcaaagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagggatatgtgggccactggatctttgccagacttcccagctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtgggttcacaggctgcagcctcagccaggagcacgtagagtcactctgctggttgctgagcaagtgtaaagacctcagccaggtggatctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagagactccacaaggcacacagagaaactgtccttccccacactggaggcctgtgctttgggatttaagaaaaaaagaaagaaagaaagaaagaaggtttcagaggatactgaactgaggacaaaaataaactga

SEQ ID NO: 8021 - DNA, 1240 bp, synthetic construct
  misc_feature 1..1240: note = Synthetic polypeptide
  source 1..1240: mol_type = other DNA
ggccgggcacggtggctcacacctatcatcccagcactttgggaagcaaagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagggatatgtgggccactggatctttgccagacttcccagctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggcaggttcacaggctgcagcctcagccaggagcacgtagagtcactctgctggttgctgagcaagtgtaaagacctcagccaggtggatctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaagtgcctaggaagctggcatgtctgggcaccgtgcttccccaggcccttctctctgcagcctgggctctga

SEQ ID NO: 8022 - DNA, 1385 bp, synthetic construct
  misc_feature 1..1385: note = Synthetic polypeptide
  source 1..1385: mol_type = other DNA
ggccgggcacggtggctcacacctatcatcccagcactttgggaagcaaagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtgggttcacaggctgcagcctcagccaggagcacgtagagtcactctgctggttgctgagcaagtgtaaagacctcagccaggtggatctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagagactccacaaggcacacagagaaactgtccttccccacactggaggcctgtgctttgggatttaagaaaaaaa

SEQ ID NO: 8023 - DNA, 1247 bp, synthetic construct
  misc_feature 1..1247: note = Synthetic polypeptide
  source 1..1247: mol_type = other DNA
ggccgggcacggtggctcacacctatcatcccagcactttgggaagcaaagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggcaggttcacaggctgcagcctcagccaggagcacgtagagtcactctgctggttgctgagcaagtgtaaagacctcagccaggtggacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagagactccacaaggcacacagagaaactgtccttccccacactggaggcctgtgctttgggatttaagaaaaaaagaaagaaagaaagaaagaaggtttcagaggata

SEQ ID NO: 8024 - DNA, 857 bp, synthetic construct
  misc_feature 1..857: note = Synthetic polypeptide
  source 1..857: mol_type = other DNA
ggccgggcgcagtggctcacacctgcaatcccagcactttgggaggccgaagcagacagatcacttgaggagacagtgtttcacaaaatgattttccttctgaagctcccatctccttgaatctttctcataacatctgcaatcccatgaccgtgaatagtctcccacaatacgcagagccttcctgtcccagccttcctgccgggcccacaggtgttgaagaagataaaggtctttactcacctggagacctgtggcccactccgccagtgtgtgtgacaagcagcttaaactgcaccctggagaacggcgtgccttgtgtgattcaggagtcggccccggttcataatagtttcattgattggagtgcaacatgcgaaggccagttttccagcgcatactgtccattggaattgaacgattacaatgcctttccagaagaaaacatgaactatgccaatggcttcccctgtcctgcagatgttcagacagactttattgatcacaactctcagtctacctggaacaccccacccaacatgcctgctgcctggggacatgccagtttcatcagctctccgccctacctcacaagcacccgaagcttgtctccaatgtctggactttttggttccatctgggccccgcaaagcgatgtgtatgaaaattgctgccccatcaaccccaccacggaacattcgacccacatggaaaaccaagcggtcgtgtgcaaggaatactacccggggttcaacccgtttcgcgcctatatgaacctggacatatggactaccacagcgaataggaatgcaaatttcccactgtctagagactcgagttactgtgggaatgtgtga

SEQ ID NO: 8025 - DNA, 2162 bp, synthetic construct
  misc_feature 1..2162: note = Synthetic polypeptide
  source 1..2162: mol_type = other DNA
caaaaaaaacccaaaaaaggcaaaggactggaatagacgtttattcaaagaagatgcacaaatggccagtaagcccatgaaaagatgctcaacgtcactaatcataaggtaaatgcaaatcaaaaccacagtgagataccaccgtacacctgttgaggacagcaactatcaaaacagaaaatggcacatatcagtgaggatgcggagaaatgggaacccttgtgcactgctggtaggaagtgaaacggtgcatctgctgtgaaaaactcaaaaaactaagtgtggaactaccatgtgatccagcagttccactgctgggcacgtgccccagcagcactgaaagcagggtcttgaagagatgcttgtacacccacgttgatagcagcatcaaccacagcagccaaaagggggaagccacccgagggtcggctgtcgggcgaacggatcagcaaagtgtcgtgtgcaaaacgcagtgacgtgtgactcagcctgagaagcagcgaagctggggcccgcgctgcagcgtggatgagcctcggggacactgtgccgaatgaacttgcttgccttttgttttagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcagttctgcaggctgggaagcccaaggtcgaggggctgcctttggtga

SEQ ID NO: 8026 - DNA, 2306 bp, synthetic construct
  misc_feature 1..2306: note = Synthetic polypeptide
  source 1..2306: mol_type = other DNA
caaaaaaaacccaaaaaaggcaaaggactggaatagacgtttattcaaagaagatgcacaaatggccagtaagcccatgaaaagatgctcaacgtcactaatcataaggtaaatgcaaatcaaaaccacagtgagataccaccgtacacctgttgaggacagcaactatcaaaacagaaaatggcacatatcagtgaggatgcggagaaatgggaacccttgtgcactgctggtaggaagtgaaacggtgcatctgctgtgaaaaactcaaaaaactaagtgtggaactaccatgtgatccagcagttccactgctgggcacgtgccccagcagcactgaaagcagggtcttgaagagatgcttgtacacccacgttgatagcagcatcaaccacagcagccaaaagggggaagccacccgagggtcggctgtcgggcgaacggatcagcaaagtgtcgtgtgcaaaacgcagtgacgtgtgactcagcctgagaagcagcgaagctggggcccgcgctgcagcgtggatgagcctcggggacactgtgccgaatgaacttgcttgccttttgttttagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcaggcgggcgctaatattgacacctgctcagaagaccagaggaccccgttgatggaagcagccgaaaacaaccatctggaagcagtgaagtacctcatcaaggctggggccctggtggatcccaagatacagaaaacttctaaagtttatacggagtctcaagagacccagagaagccaaacaattttgtga

SEQ ID NO: 8027 - DNA, 3632 bp, synthetic construct
  misc_feature 1..3632: note = Synthetic polypeptide
  source 1..3632: mol_type = other DNA
caaaaaaaacccaaaaaaggcaaaggactggaatagacgtttattcaaagaagatgcacaaatggccagtaagcccatgaaaagatgctcaacgtcactaatcataaggtaaatgcaaatcaaaaccacagtgagataccaccgtacacctgttgaggacagcaactatcaaaacagaaaatggcacatatcagtgaggatgcggagaaatgggaacccttgtgcactgctggtaggaagtgaaacggtgcatctgctgtgaaaaactcaaaaaactaagtgtggaactaccatgtgatccagcagttccactgctgggcacgtgccccagcagcactgaaagcagggtcttgaagagatgcttgtacacccacgttgatagcagcatcaaccacagcagccaaaagggggaagccacccgagggtcggctgtcgggcgaacggatcagcaaagtgtcgtgtgcaaaacgcagtgacgtgtgactcagcctgagaagcagcgaagctggggcccgcgctgcagcgtggatgagcctcggggacactgtgccgaatgaacttgcttgccttttgttttagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcaggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcgagccatgccccagcaactacaagtacgtctctcagaactgcgtgacgtcccccatgaacatcgacagaaatatcactcatctgcagtactgcgtgtgcatcgacgactgctcctccagcaactgcatgtgcggccagctcagcatgcgctgctggtacgacaaggatggccggctcctgccagagttcaacatggcggagcctcccttgatcttcgaatgcaaccacgcgtgctcctgctggaggaactgccgaaatcgcgtcgtacagaatggtctcagggcaaggctgcagctctaccggacgcgggacatgggctggggcgtgcggtccctgcaggacatcccaccaggcacctttgtctgcgagtatgttggggagctgatttcagactcagaagccgacgttcgagaggaagattcttacctctttgatctcgacaataaggacggggaggtttactgcatcgacgcgcggttctacgggaacgtcagccggttcatcaaccaccactgcgagcccaacctggtgcccgtgcgcgtgttcatggcccaccaggacctgcggttcccccggatcgccttcttcagcacccgcctgatcgaggccggcgagcagctcgggtttgactatggagagcgcttctgggacatcaaaggcaagctcttcagctgccgctgcggctcccccaagtgccggcactcgagcgcggccctggcccagcgtcaggccagcgcggcccaggaggcccaggaggacggcttgcccgacaccagctccgcggctgccgccgaccccctatga

SEQ ID NO: 8028 - DNA, 781 bp, synthetic construct
  misc_feature 1..781: note = Synthetic polypeptide
  source 1..781: mol_type = other DNA
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtgagtgaaccatggtgaagtggatcctccagccgtagttaaatctccagatgactacagccccagccaacatcttgactgcaacctcataaaacactgtgagcagaaatcatccaactaagctgctcccagattcctgacccacaaaaactacagtaggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagaaagacacaccgacctggaccaagggagacaggcataaacagctccaaagggaaacacacgggaaaaagagagaacaagagaaagaaatagacgccctgaaagaagagacagagacttatgagccgtag

SEQ ID NO: 8029 - DNA, 680 bp, synthetic construct
  misc_feature 1..680: note = Synthetic polypeptide
  source 1..680: mol_type = other DNA
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtgagtgaaccatggtgaagtggatcctccagccgtagttaaatctccagatgactacagccccagccaacatcttgactgcaacctcataaaacactgtgagcagaaatcatccaactaagctgctcccagattcctgacccacaaaaactacagtaggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtag

SEQ ID NO: 8030 - DNA, 1156 bp, synthetic construct
  misc_feature 1..1156: note = Synthetic polypeptide
  source 1..1156: mol_type = other DNA
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtgagtgaaccatggtgaagtggatcctccagccgtagttaaatctccagatgactacagccccagccaacatcttgactgcaacctcataaaacactgtgagcagaaatcatccaactaagctgctcccagattcctgacccacaaaaactacagtaggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttag

SEQ ID NO: 8031 - DNA, 1123 bp, synthetic construct
  misc_feature 1..1123: note = Synthetic polypeptide
  source 1..1123: mol_type = other DNA
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtgagtgaaccatggtgaagtggatcctccagccgtagttaaatctccagatgactacagccccagccaacatcttgactgcaacctcataaaacactgtgagcagaaatcatccaactaagctgctcccagattcctgacccacaaaaactacagtaggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgaggtgatctggccccgcccccacccgcgatcggccctaaatccctag

SEQ ID NO: 8032 - DNA, 648 bp, synthetic construct
  misc_feature 1..648: note = Synthetic polypeptide
  source 1..648: mol_type = other DNA
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtgagtgaaccatggtgaagtggatcctccagccgtagttaaatctccagatgactacagccccagccaacatcttgactgcaacctcataaaacactgtgagcagaaatcatccaactaagctgctcccagattcctgacccacaaaaactacagtaggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggc

SEQ ID NO: 8033 - DNA, 678 bp, synthetic construct
  misc_feature 1..678: note = Synthetic polypeptide
  source 1..678: mol_type = other DNA
tgatgtggtttgggtctgtgtccccacccaaatctcatgttcagttataattcccaatattgaggtagggtgtgatgggcctgctccatgggagtacgagtcctagtcaccgtgggggcggtttctcatgaatggtttagcaccatccgctttggtactgtggtctgtggtagtgagttctcttgcgatctggctgtttaaaagtgtgtggcacctcccccttctctttcttgctcctgcttccaccatgtgagactccttgctccccctttgccttctgccatgattggaagcttcctgaggcctccccagaagcagaagctgctgtgcttcctgtacatcctgcagaactatgagccaattaagcctcttttctctataaattactcagtctcagattctggggagcaggtcctggtggatgtggagaccaagagcaataaggagatcatggagcacatcagaaaaatcttggggaagaatgaggaaaccctcagggaagaggaggaggagaaaaagcagctttctcacccagccaacttcggccctcgaaagtactgcctgcgggagtgcatctgtgaagtggaagggcaggtgccctgccccagcctggtgccattacccaaggagatgagggggaagtacaaagccgctctgaaagccgatgcccaggactaa

SEQ ID NO: 8034 - DNA, 594 bp, synthetic construct
  misc_feature 1..594: note = Synthetic polypeptide
  source 1..594: mol_type = other DNA
tgatgtggtttgggtctgtgtccccacccaaatctcatgttcagttataattcccaatattgaggtagggtgtgatgggcctgctccatgggagtacgagtcctagtcaccgtgggggcggtttctcatgaatggtttagcaccatccgctttggtactgtggtctgtggtagtgagttctcttgcgatctggctgtttaaaagtgtgtggcacctcccccttctctttcttgctcctgcttccaccatgtgagactccttgctccccctttgccttctgccatgattggaagcttcctgaggcctccccagaagcagaagctgctgtgcttcctgtacatcctgcagaactatgagccaattaagcctcttttctctataaattactcagtctcagattctggggagcaggtcctggtggatgtggagaccaagagcaataaggagatcatggagcacatcagaaaaatcttggggaagaatgagcactacctggcagcaccatctaaacctgtatcatctgctgtggtcccagttactcaggaggctgaggcaggaggatcacttgagcccaggaggttgaggctggagtga

SEQ ID NO: 8035 - DNA, 489 bp, synthetic construct
  misc_feature 1..489: note = Synthetic polypeptide
  source 1..489: mol_type = other DNA
tgatgtggtttgggtctgtgtccccacccaaatctcatgttcagttataattcccaatattgaggtagggtgtgatgggcctgctccatgggagtacgagtcctagtcaccgtgggggcggtttctcatgaatggtttagcaccatccgctttggtactgtggtctgtggtagtgagttctcttgcgatctggctgtttaaaagtgtgtggcacctcccccttctctttcttgctcctgcttccaccatgtgagactccttgctccccctttgccttctgccatgattggaagcttcctgaggcctccccagaagcagaagctgctgtgcttcctgtacatcctgcagaactatgagccaattaagcctcttttctctataaattactcagtctcagattctggggagcaggtcctggtggatgtggagaccaagagcaataaggagatcatggagcacatcagaaaaatcttggggaagaatgagtga

SEQ ID NO: 8036 - DNA, 959 bp, synthetic construct
  misc_feature 1..959: note = Synthetic polypeptide
  source 1..959: mol_type = other DNA
aaaaagcatgggatttggaatttgagacctgactttgaagcccacacagaacacagacaagtcaaccatgctatttgggcaaagacctgaccttgaagatgggaagtgccctcttcgtcaagaaggagctgcagctgcaggcaaatttcttgggcaatgtcaagaggctgtatgaagcagaagtcttttctacagatttctccaacccctccattgcccaggcgaggatcaacagccatgtgaaaaagaagacccaagggaaggttgtagacataatccaaggccttgaccttctgacggccatggttctggtgaaccacattttctttaaagccaagtgggagaagccctttcaccctgaatatacaagaaagaacttcccattcctggtgggcgagcaggtcactgtgcatgtccccatgatgcaccagaaagagcagttcgcttttggggtggatacagagctgaactgctttgtgctgcagatggattacaagggagatgccgtggccttctttgtcctccctagcaagggcaagatgaggcaactggaacaggccttgtcagccagaacactgagaaagtggagccactcactccagaaaaggtggatagaggtgttcatccccagattttccatttctgcctcctacaatctggaaaccatcctcccgaagatgggcatccaaaatgtctttgacaaaaatgctgatttttctggaattgcaaagagagactccctgcaggtttctaaagcaacccacaaggctgtgctggatgtcagtgaagagggcactgaggccacagcagctaccaccaccaagttcatagtccgatcgaaggatggcccctcttacttcactgtctccttcaataggaccttcctgatgatgattacaaataaagccacagacggtattctctttctagggaaagtggaaaatcccactaaatcctag

SEQ ID NO: 8037 - DNA, 175 bp, synthetic construct
  misc_feature 1..175: note = Synthetic polypeptide
  source 1..175: mol_type = other DNA
aaaaagcatgggatttggaatttgagacctgactttgaagcccacacagaacacagacaagtcaaccatgctatttgggcaaagacctgaccttgaagatgggaagtgccctcttcgtcaagaaggagctgcagctgcaggcaaatttcttgggcaatgtcaagaggctgtatga

SEQ ID NO: 8038 - DNA, 764 bp, synthetic construct
  misc_feature 1..764: note = Synthetic polypeptide
  source 1..764: mol_type = other DNA
aaaaagcatgggatttggaatttgagacctgactttgaagcccacacagaacacagacaagtcaaccatgctatttgggcaaagacctgaccttgaagatgggaagtgccctcttcgtcaagaaggagctgcagctgcaggcaaatttcttgggcaatgtcaagaggctgtatgaagcagaagtcttttctacagatttctccaacccctccattgcccaggcgaggatcaacagccatgtgaaaaagaagacccaagggaaggttgtagacataatccaaggccttgaccttctgacggccatggttctggtgaaccacattttctttaaagccaagtgggagaagccctttcaccctgaatatacaagaaagaacttcccattcctggtgggcgagcaggtcactgtgcatgtccccatgatgcaccagaaagagcagttcgcttttggggtggatacagagctgaactgctttgtgctgcagatggattacaagggagatgccgtggccttctttgtcctccctagcaagggcaagatgaggcaactggaacaggccttgtcagccagaacactgagaaagtggagccactcactccagaaaaggtggatagaggtgttcatccccagattttccatttctgcctcctacaatctggaaaccatcctcccgaagatgggcatccaaaatgtctttgacaaaaatgctgatttttctggaattgcaaagagagactccctgcaggtttctaaagtgagttga

SEQ ID NO: 8039 - DNA, 355 bp, synthetic construct
  misc_feature 1..355: note = Synthetic polypeptide
  source 1..355: mol_type = other DNA
gcggaaaagcaagtaaccgggaatgaaggaagtgggggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctag

SEQ ID NO: 8040 - DNA, 1631 bp, synthetic construct; identical to SEQ ID NO: 7615
  misc_feature 1..1631: note = Synthetic polypeptide
  source 1..1631: mol_type = other DNA

SEQ ID NO: 8041 - DNA, 434 bp, synthetic construct
  misc_feature 1..434: note = Synthetic polypeptide
  source 1..434: mol_type = other DNA
gcggaaaagcaagtaaccgggaatgaaggaagtggggtcagtcccaaccctgccacgtgcgggtctcgagacggtggacaagtggctggactccactgggcctgggctgtcactgggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctag

SEQ ID NO: 8042 - DNA, 278 bp, synthetic construct
  misc_feature 1..278: note = Synthetic polypeptide
  source 1..278: mol_type = other DNA
ggccaggcgcggtggcttacgcctgtaatcccagcactttgggaagccgaggcaggtggatcacctgaggtcaggagttcgagaccagtctgaccaataaggaagtgaaagtacttagcattgatcaaagaaatttcaaattacgatcaattgggtggggagaagaattttcattgtccaagcaccctcagggaacagaagtcaaagcaataacatattcagcaatgcaggtctataatgaagagaacccggaagtttttgtgatcattgacatttaa

SEQ ID NO: 8043 - DNA, 180 bp, synthetic construct
  misc_feature 1..180: note = Synthetic polypeptide
  source 1..180: mol_type = other DNA
atctgagttcaaacccttgtttttctgctttaaagccatgagatcttgggcaagtcacagccttgatttcttcatccgtaaaagtgtttcattgtactgacaacctcagctggcatcatggaccatgaagaagcaagacgaaaacacacaggagggaaaatcctgggattctttttctag

SEQ ID NO: 8044 - DNA, 100 bp, synthetic construct
  misc_feature 1..100: note = Synthetic polypeptide
  source 1..100: mol_type = other DNA
atctgagttcaaacccttgtttttctgctttaaagccatgagatcttgggcaagtcacagccttgatttcttcatccgtaaaagtgtttcattgtactga

SEQ ID NO: 8045 - DNA, 1267 bp, synthetic construct; identical to SEQ ID NO: 463
  misc_feature 1..1267: note = Synthetic polypeptide
  source 1..1267: mol_type = other DNA

SEQ ID NO: 8046 - DNA, 249 bp, synthetic construct
  misc_feature 1..249: note = Synthetic polypeptide
  source 1..249: mol_type = other DNA
tgggcctctctggcctatttcccatgatttcctccttctcttgctctgtattccaggggagctgaccccttgggttttccaggctccaggatcagttggtcctcactgtcttcaaccaatgggaggcactgtggaaagactgcaggtgaagcccaagagccaaaggaatcaccaccaccttctaaaacgtcagcagctgctcagttggatgagctcatggctcacctgactgagatgcaggccaagtag

SEQ ID NO: 8047 - DNA, 1089 bp, synthetic construct
  misc_feature 1..1089: note = Synthetic polypeptide
  source 1..1089: mol_type = other DNA
tgggcctctctggcctatttcccatgatttcctccttctcttgctctgtattccaggggagctgaccccttgggttttccaggctccaggatcagttggtcctcactgtcttcaaccaatgggaggcactgtggaaagactgcaggtgaagcccaagagccaaaggaatcaccaccaccttctaaaacgtcagcagctgctcagttggatgagctcatggctcacctgactgagatgcaggccaaggttgcagtgagagcagatgctggcaagaagcacttaccagacaagcaggatcacaaggcctccctggactcaatgcttgggggtctggagcaggaattgcaggaccttggcattgccacagtgcccaagggccattgtgcatcctgccagaaaccgattgctgggaaggtgatccatgctctagggcaatcatggcatcctgagcattttgtctgtactcattgcaaagaagagattggctccagtcccttctttgagcggagtggcttggcctactgccccaacgactaccaccaacttttttctccacgctgtgcttactgcgctgctcccatcctggataaagtgctgacagcaatgaaccagacctggcacccagagcacttcttctgctctcactgcggagaggtgtttggtgcagaaggctttcatgagaaggacaagaagccatattgccgaaaggatttcttagccatgttctcacccaagtgtggtggctgcaatcgcccagtgttggaaaactacctttcagccatggacactgtctggcacccagagtgctttgtttgtggggactgcttcaccagtttttctactggctccttctttgaactggatggacgtccattctgtgagctccattaccatcaccgccggggaacgctctgccatgggtgtgggcagcccatcactggccgttgtatcagtgccatggggtacaagttccatcctgagcactttgtgtgtgctttctgcctgacacagttgtcgaagggcattttcagggagcagaatgacaagacctattgtcaaccttgcttcaataagctcttcccactgtaa

SEQ ID NO: 8048 - DNA, 2243 bp, synthetic construct
  misc_feature 1..2243: note = Synthetic polypeptide
  source 1..2243: mol_type = other DNA
ctctccctctccctgtccctgtccctctccctctccccatggtttccctctccctctctttccacggtctccctctcatgccgagccgaagctggactatactgctgccatctcggctcactgcaacctccctgcctgattctcctgcctcagcctgcggagtgcctgcaattgcaggtgcgcgccgccacgcctgactggttttcgtatttttttggtggagacggggtttcgctgtgatggccaggctggtctccagctcctaaccgcgagtggtccgccagcctcggactcccgaggtgccgggattgcagacggagtctggttctctcagtgctcaatggcgcccaggctggagcgcagtggcgtgatctcggctcgctacaacctccacctcccagccgcctgccttggcctcccaaagtgccgagattgcagcctctgccaggccgccaccccgtctgggaagtgaggagcgtctctgcctggccgcccatcgtctgggacgtgaggagtccctctgcctggctgcccagtctggaaagtgaggagcgtctctgcccagccgccatcccatctcggaagtgaggagcgcctcttcccggccgccatcacatctaggaagtgaggagcgtctctgcccggccgcccatcgtctgggatgtggggagtgcctctgccccgccgccccgtctgggatgtgaggagcgcctctgcccggccgccaccccgtctgggaggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaa

SEQ ID NO: 8049 - DNA, 1338 bp, synthetic construct
  misc_feature 1..1338: note = Synthetic polypeptide
  source 1..1338: mol_type = other DNA
ctctccctctccctgtccctgtccctctccctctccccatggtttccctctccctctctttccacggtctccctctcatgccgagccgaagctggactatactgctgccatctcggctcactgcaacctccctgcctgattctcctgcctcagcctgcggagtgcctgcaattgcaggtgcgcgccgccacgcctgactggttttcgtatttttttggtggagacggggtttcgctgtgatggccaggctggtctccagctcctaaccgcgagtggtccgccagcctcggactcccgaggtgccgggattgcagacggagtctggttctctcagtgctcaatggcgcccaggctggagcgcagtggcgtgatctcggctcgctacaacctccacctcccagccgcctgccttggcctcccaaagtgccgagattgcagcctctgccaggccgccaccccgtctgggaagtgaggagcgtctctgcctggccgcccatcgtctgggacgtgaggagtccctctgcctggctgcccagtctggaaagtgaggagcgtctctgcccagccgccatcccatctcggaagtgaggagcgcctcttcccggccgccatcacatctaggaagtgaggagcgtctctgcccggccgcccatcgtctgggatgtggggagtgcctctgccccgccgccccgtctgggatgtgaggagcgcctctgcccggccgccaccccgtctgggaggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaacccca

SEQ ID NO: 8050 - DNA, 1263 bp, synthetic construct
  misc_feature 1..1263: note = Synthetic polypeptide
  source 1..1263: mol_type = other DNA
ctctccctctccctgtccctgtccctctccctctccccatggtttccctctccctctctttccacggtctccctctcatgccgagccgaagctggactatactgctgccatctcggctcactgcaacctccctgcctgattctcctgcctcagcctgcggagtgcctgcaattgcaggtgcgcgccgccacgcctgactggttttcgtatttttttggtggagacggggtttcgctgtgatggccaggctggtctccagctcctaaccgcgagtggtccgccagcctcggactcccgaggtgccgggattgcagacggagtctggttctctcagtgctcaatggcgcccaggctggagcgcagtggcgtgatctcggctcgctacaacctccacctcccagccgcctgccttggcctcccaaagtgccgagattgcagcctctgccaggccgccaccccgtctgggaagtgaggagcgtctctgcctggccgcccatcgtctgggacgtgaggagtccctctgcctggctgcccagtctggaaagtgaggagcgtctctgcccagccgccatcccatctcggaagtgaggagcgcctcttcccggccgccatcacatctaggaagtgaggagcgtctctgcccggccgcccatcgtctgggatgtggggagtgcctctgccccgccgccccgtctgggatgtgaggagcgcctctgcccggccgccaccccgtctgggaggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctga

SEQ ID NO: 8051 - DNA, 834 bp, synthetic construct
  misc_feature 1..834: note = Synthetic polypeptide
  source 1..834: mol_type = other DNA
gaagccatctgttccccaggaagccttccctgatgtgctgtttggtcgcatcttgtgtatacctacgtatctgcacttatccttctgaacctgctgttgtcctgtcacttgtgtttccttctgtgacttatacgcgtctgcagaacaggaccggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtga

SEQ ID NO: 8052 - DNA, 679 bp, synthetic construct
  misc_feature 1..679: note = Synthetic polypeptide
  source 1..679: mol_type = other DNA
gaagccatctgttccccaggaagccttccctgatgtgctgtttggtcgcatcttgtgtatacctacgtatctgcacttatccttctgaacctgctgttgtcctgtcacttgtgtttccttctgtgacttatacgcgtctgcagaacaggaccggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactggg

SEQ ID NO: 8053 - DNA, 2254 bp, synthetic construct
  misc_feature 1..2254: note = Synthetic polypeptide
  source 1..2254: mol_type = other DNA
tttatacaactgtagctgatgtgctcttgtaagtgccaactcctggctggaggccagccaatacaaaaccagcgcacttaacaaaaatacaaccaaggaccttcacagaatctacttcacacccctgttacctccaccagagtaagtgctggtatccacgcctgagagacctggagacagatcacatcacaggactctttgcagacactctccagtaccagcttagagcctgattatctccactgggcggctagatcaagaagagaaataacaatcactgcagtttggctctcaggaagccccatccctaggggaaaggggagagcaccacatcaagggagcatccctgtgggacaaaagaatctgaacagcagcccttgagttccagatcttccctctgacatagtctatccagatgagaaggaactggaaaaacaactggggtaatatgacaaaacagggttctttgacactctgaaaaggtcacactagcttaccagcaatggatctaaaccaagacaaaaatctctgaattgccagaaaaagaattcacaaggtcattattacgccaatcaaggaggcacgagagaaaggtgaagtccaacttagcaaaacaaaaaaagtgatacaggatatgaatggaaaaatttccaggaaaatagcataaataaataatcacaacttctgaaaatcaagggacacacttagagacatgcaaaatgcactggaaagtctcagcaatagaattgaataagtagaagaaagaaatttcagagttcgaagacaaggcttttgaattagcccaatctgacaaagacaaaaaagaatttaaaaaaatgaacgcagcctccaataagtttgttaaacaaccaagcctaagaataattggtgttcccaaggaagaagaagaatctaaaagtttggaaaacaaatttgagggattaattgaggaaaacttccccggccttgctagagatctagacatccaaatacaagaagcttaaagaacacctgggaaattcatcacaaaaagatcatcacctaggcacatagtcatcaggttaactaaagtcaagatgaaggaaagaatcttaagagctgtgagtcaaaagcctcaggtaacctataaaggaaaacctatcagattaacagatttctcagcagaaactctaaaagctagaagggattgggatcctatcttgagcctccttaagttatcagccagtaattttgtatccagtgaaacagagcttcataaatgaaggaaagtagtctttttcacacaaacaagtgctgagagaatttgccactaccaagccagcactacaagaactgctaaaaggagctccaaatcttgaaacaaattctcaaaataccaaaattgtatctccttaaagcataaatcacacaggacctataaaacaataacacaatgaagaaaaaaaacaaggtgttcaggcaaacaaatagcacgatgaatagaatagtacctcaaatctcaatactaatgttgaatgtaaatggcctacatgctccactttaaagatacagaatagcagaatggataagaactcatcaaccaagtatctgctgtcttcaagagattcaccagacacaaaaggactcaaatttaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaa

SEQ ID NO: 8054 - DNA, 2044 bp, synthetic construct
  misc_feature 1..2044: note = Synthetic polypeptide
  source 1..2044: mol_type = other DNA
tttatacaactgtagctgatgtgctcttgtaagtgccaactcctggctggaggccagccaatacaaaaccagcgcacttaacaaaaatacaaccaaggaccttcacagaatctacttcacacccctgttacctccaccagagtaagtgctggtatccacgcctgagagacctggagacagatcacatcacaggactctttgcagacactctccagtaccagcttagagcctgattatctccactgggcggctagatcaagaagagaaataacaatcactgcagtttggctctcaggaagccccatccctaggggaaaggggagagcaccacatcaagggagcatccctgtgggacaaaagaatctgaacagcagcccttgagttccagatcttccctctgacatagtctatccagatgagaaggaactggaaaaacaactggggtaatatgacaaaacagggttctttgacactctgaaaaggtcacactagcttaccagcaatggatctaaaccaagacaaaaatctctgaattgccagaaaaagaattcacaaggtcattattacgccaatcaaggaggcacgagagaaaggtgaagtccaacttagcaaaacaaaaaaagtgatacaggatatgaatggaaaaatttccaggaaaatagcataaataaataatcacaacttctgaaaatcaagggacacacttagagacatgcaaaatgcactggaaagtctcagcaatagaattgaataagtagaagaaagaaatttcagagttcgaagacaaggcttttgaattagcccaatctgacaaagacaaaaaagaatttaaaaaaatgaacgcagcctccaataagtttgttaaacaaccaagcctaagaataattggtgttcccaaggaagaagaagaatctaaaagtttggaaaacaaatttgagggattaattgaggaaaacttccccggccttgctagagatctagacatccaaatacaagaagcttaaagaacacctgggaaattcatcacaaaaagatcatcacctaggcacatagtcatcaggttaactaaagtcaagatgaaggaaagaatcttaagagctgtgagtcaaaagcctcaggtaacctataaaggaaaacctatcagattaacagatttctcagcagaaactctaaaagctagaagggattgggatcctatcttgagcctccttaagttatcagccagtaattttgtatccagtgaaacagagcttcataaatgaaggaaagtagtctttttcacacaaacaagtgctgagagaatttgccactaccaagccagcactacaagaactgctaaaaggagctccaaatcttgaaacaaattctcaaaataccaaaattgtatctccttaaagcataaatcacacaggacctataaaacaataacacaatgaagaaaaaaaacaaggtgttcaggcaaacaaatagcacgatgaatagaatagtacctcaaatctcaatactaatgttgaatgtaaatggcctacatgctccactttaaagatacagaatagcagaatggataagaactcatcaaccaagtatctgctgtcttcaagagattcaccagacacaaaaggactcaaatttaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatttgttagcatcagtgacctcctggtaccaaaagacttgggaacagaaagccagatctttatttcccgcacatatgatgccaccactcattttgagacaacgtgtgatgacattaaaaacatctataagaggatga

SEQ ID NO: 8055 - DNA, 1735 bp, synthetic construct
  misc_feature 1..1735: note = Synthetic polypeptide
  source 1..1735: mol_type = other DNA
tttatacaactgtagctgatgtgctcttgtaagtgccaactcctggctggaggccagccaatacaaaaccagcgcacttaacaaaaatacaaccaaggaccttcacagaatctacttcacacccctgttacctccaccagagtaagtgctggtatccacgcctgagagacctggagacagatcacatcacaggactctttgcagacactctccagtaccagcttagagcctgattatctccactgggcggctagatcaagaagagaaataacaatcactgcagtttggctctcaggaagccccatccctaggggaaaggggagagcaccacatcaagggagcatccctgtgggacaaaagaatctgaacagcagcccttgagttccagatcttccctctgacatagtctatccagatgagaaggaactggaaaaacaactggggtaatatgacaaaacagggttctttgacactctgaaaaggtcacactagcttaccagcaatggatctaaaccaagacaaaaatctctgaattgccagaaaaagaattcacaaggtcattattacgccaatcaaggaggcacgagagaaaggtgaagtccaacttagcaaaacaaaaaaagtgatacaggatatgaatggaaaaatttccaggaaaatagcataaataaataatcacaacttctgaaaatcaagggacacacttagagacatgcaaaatgcactggaaagtctcagcaatagaattgaataagtagaagaaagaaatttcagagttcgaagacaaggcttttgaattagcccaatctgacaaagacaaaaaagaatttaaaaaaatgaacgcagcctccaataagtttgttaaacaaccaagcctaagaataattggtgttcccaaggaagaagaagaatctaaaagtttggaaaacaaatttgagggattaattgaggaaaacttccccggccttgctagagatctagacatccaaatacaagaagcttaaagaacacctgggaaattcatcacaaaaagatcatcacctaggcacatagtcatcaggttaactaaagtcaagatgaaggaaagaatcttaagagctgtgagtcaaaagcctcaggtaacctataaaggaaaacctatcagattaacagatttctcagcagaaactctaaaagctagaagggattgggatcctatcttgagcctccttaagttatcagccagtaattttgtatccagtgaaacagagcttcataaatgaaggaaagtagtctttttcacacaaacaagtgctgagagaatttgccactaccaagccagcactacaagaactgctaaaaggagctccaaatcttgaaacaaattctcaaaataccaaaattgtatctccttaaagcataaatcacacaggacctataaaacaataacacaatgaagaaaaaaaacaaggtgttcaggcaaacaaatagcacgatgaatagaatagtacctcaaatctcaatactaatgttgaatgtaaatggcctacatgctccactttaaagatacagaatagcagaatggataagaactcatcaaccaagtatctgctgtcttcaagagattcaccagacacaaaaggactcaaatttaaggctaagtgctatttatggaggtacctatatgctgaataaacccattgaagaaatcattgtacagaatggaaaagtaattggtgtaaaatctgaaggagaa

SEQ ID NO: 8056 - DNA, 3021 bp, synthetic construct; identical to SEQ ID NO: 449
  misc_feature 1..3021: note = Synthetic polypeptide
  source 1..3021: mol_type = other DNA

SEQ ID NO: 8057 - DNA, 3075 bp, synthetic construct; identical to SEQ ID NO: 450
  misc_feature 1..3075: note = Synthetic polypeptide
  source 1..3075: mol_type = other DNA

SEQ ID NO: 8058 - DNA, 1143 bp, synthetic construct; identical to SEQ ID NO: 451
  misc_feature 1..1143: note = Synthetic polypeptide
  source 1..1143: mol_type = other DNA

SEQ ID NO: 8059 - DNA, 427 bp, synthetic construct; identical to SEQ ID NO: 573
  misc_feature 1..427: note = Synthetic polypeptide
  source 1..427: mol_type = other DNA

SEQ ID NO: 8060 - DNA, 163 bp, synthetic construct; identical to SEQ ID NO: 480
  misc_feature 1..163: note = Synthetic polypeptide
  source 1..163: mol_type = other DNA

SEQ ID NO: 8061 - DNA, 104 bp, synthetic construct; identical to SEQ ID NO: 481
  misc_feature 1..104: note = Synthetic polypeptide
  source 1..104: mol_type = other DNA

SEQ ID NO: 8062 - DNA, 404 bp, synthetic construct; identical to SEQ ID NO: 6813
  misc_feature 1..404: note = Synthetic polypeptide
  source 1..404: mol_type = other DNA

SEQ ID NO: 8063 - DNA, 417 bp, synthetic construct; identical to SEQ ID NO: 6814
  misc_feature 1..417: note = Synthetic polypeptide
  source 1..417: mol_type = other DNA

SEQ ID NO: 8064 - DNA, 485 bp, synthetic construct; identical to SEQ ID NO: 6815
  misc_feature 1..485: note = Synthetic polypeptide
  source 1..485: mol_type = other DNA

SEQ ID NO: 8065 - DNA, 1745 bp, synthetic construct; identical to SEQ ID NO: 6816
  misc_feature 1..1745: note = Synthetic polypeptide
  source 1..1745: mol_type = other DNA

SEQ ID NO: 8066 - DNA, 605 bp, synthetic construct
  misc_feature 1..605: note = Synthetic polypeptide
  source 1..605: mol_type = other DNA
ggaggaggcggtggaggaagaggtggcggcggtggcggtggtcgtagcggtggcggaggaggcggacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactga

SEQ ID NO: 8067 - DNA, 372 bp, synthetic construct
  misc_feature 1..372: note = Synthetic polypeptide
  source 1..372: mol_type = other DNA
ggaggaggcggtggaggaagaggtggcggcggtggcggtggtcgtagcggtggcggaggaggcggacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtctt

SEQ ID NO: 8068 - DNA, 422 bp, synthetic construct
  misc_feature 1..422: note = Synthetic polypeptide
  source 1..422: mol_type = other DNA
ggaggaggcggtggaggaagaggtggcggcggtggcggtggtcgtagcggtggcggaggaggcggacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactga

SEQ ID NO: 8069 - DNA, 476 bp, synthetic construct
  misc_feature 1..476: note = Synthetic polypeptide
  source 1..476: mol_type = other DNA
ggaggaggcggtggaggaagaggtggcggcggtggcggtggtcgtagcggtggcggaggaggcggacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagaatgcagtaatagtggccttgtcttcaaaatcatgggatgtagagactgcaacagaattgcttctgagtaactga

SEQ ID NO: 8070 - DNA, 1629 bp, synthetic construct
  misc_feature 1..1629: note = Synthetic polypeptide
  source 1..1629: mol_type = other DNA
ctcataccttgatagtgatgtaataaattgatacaaacttctaggagaccagtctgaaaatatgcattaaaaagcatcatgttcttttactgcattacttttcttctgtgattttagcctaaagaagtaattcagaagaacacacaatccagtgatgtttgcaacaaagtcaacacagacacagaaaccgccgttgtcaacgtcacatatgcaacaagagaagaagcaaaaatagccatggagaagctaagcgggcatcagtttgagaactactccttcaagatttcctacatcccggatgaagaggtgagctccccttcgccccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggggacttctgaagcatgccgcatgattcttgaaatcatgcagaaagaggcagatgagaccaaactagccgaagagattcctctgaaaatcttggcacacaatggcttggttggaagactgattggaaaagaaggcagaaatttgaagaaaattgaacatgaaacagggaccaagataacaatctcatctttgcaggatttgagcatatacaacccggaaagaaccatcactgtgaagggcacagttgaggcctgtgccagtgctgagatagagattatgaagaagctgcgtgaggcctttgaaaatgatatgctggctgttaaccaacaagccaatctgatcccagggttgaacctcagcgcacttggcatcttttcaacaggactgtccgtgctatctccaccagcagggccccgcggagctccccccgctgccccctaccaccccttcactacccactccggatacttctccagcctgtacccccatcaccagtttggcccgttcccgcatcatcactcttatccagagcaggagattgtgaatctcttcatcccaacccaggctgtgggcgccatcatcgggaagaagggggcacacatcaaacagctggcgagattcgccggagcctctatcaagattgcccctgcggaaggcccagacgtcagcgaaaggatggtcatcatcaccgggccaccggaagcccagttcaaggcccagggacggatctttgggaaactgaaagaggaaaacttctttaaccccaaagaagaagtgaagctggaagcgcatatcagagtgccctcttccacagctggccgggtgattggcaaaggtggcaagaccgtgaacgaactgcagaacttaaccagtgcagaagtcatcgtgcctcgtgaccaaacgccagatgaaaatgaggaagtgatcgtcagaattatcgggcacttctttgctagccagactgcacagcgcaagatcagggaaattgtacaacaggtgaagcagcaggagcagaaataccctcagggagtcgcctcacagcgcagcaagtga

SEQ ID NO: 8071 - DNA, 1500 bp, synthetic construct
  misc_feature 1..1500: note = Synthetic polypeptide
  source 1..1500: mol_type = other DNA
ctcataccttgatagtgatgtaataaattgatacaaacttctaggagaccagtctgaaaatatgcattaaaaagcatcatgttcttttactgcattacttttcttctgtgattttagcctaaagaagtaattcagaagaacacacaatccagtgatgtttgcaacaaagtcaacacagacacagaaaccgccgttgtcaacgtcacatatgcaacaagagaagaagcaaaaatagccatggagaagctaagcgggcatcagtttgagaactactccttcaagatttcctacatcccggatgaagaggtgagctccccttcgccccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggggacttctgaagcatgccgcatgattcttgaaatcatgcagaaagaggcagatgagaccaaactagccgaagagattcctctgaaaatcttggcacacaatggcttggttggaagactgattggaaaagaaggcagaaatttgaagaaaattgaacatgaaacagggaccaagataacaatctcatctttgcaggatttgagcatatacaacccggaaagaaccatcactgtgaagggcacagttgaggcctgtgccagtgctgagatagagattatgaagaagctgcgtgaggcctttgaaaatgatatgctggctgttaacacccactccggatacttctccagcctgtacccccatcaccagtttggcccgttcccgcatcatcactcttatccagagcaggagattgtgaatctcttcatcccaacccaggctgtgggcgccatcatcgggaagaagggggcacacatcaaacagctggcgagattcgccggagcctctatcaagattgcccctgcggaaggcccagacgtcagcgaaaggatggtcatcatcaccgggccaccggaagcccagttcaaggcccagggacggatctttgggaaactgaaagaggaaaacttctttaaccccaaagaagaagtgaagctggaagcgcatatcagagtgccctcttccacagctggccgggtgattggcaaaggtggcaagaccgtgaacgaactgcagaacttaaccagtgcagaagtcatcgtgcctcgtgaccaaacgccagatgaaaatgaggaagtgatcgtcagaattatcgggcacttctttgctagccagactgcacagcgcaagatcagggaaattgtacaacaggtgaagcagcaggagcagaaataccctcagggagtcgcctcacagcgcagcaagtga

SEQ ID NO: 8072 - DNA, 1227 bp, synthetic construct; identical to SEQ ID NO: 7622
  misc_feature 1..1227: note = Synthetic polypeptide
  source 1..1227: mol_type = other DNA

SEQ ID NO: 8073 - DNA, 1554 bp, synthetic construct
  misc_feature 1..1554: note = Synthetic polypeptide
  source 1..1554: mol_type = other DNA
ttgtctagccttttattgattgaaaaaccttcattagctggtgcttccacattttgtgggagattcttcacagtcaagctcccagttgctcttgatcctggggccaagatttcagtcattgtggaaacagtctacacccatgtgcttcatccgtatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtag

SEQ ID NO: 8074 - DNA, 853 bp, synthetic construct
  misc_feature 1..853: note = Synthetic polypeptide
  source 1..853: mol_type = other DNA
ggggaggagccaagatggccaaataggaacagctccggtctacagctcccagcgtgagcgacgcagaagacgggtgatttctgcatttccatctgagaccagtgaccttttctatttcatagtaaacaaacttcatgagtacttgccggagtctagggataagaatgcactacaaaatcaaagccaaagggttgatgagctggtggcatgcattgaaattatacagaccctagtattgatgttcagagaaacagaaaccgagtcatcacgcctgaacacattggcagctaagaagggagcactatttaatctcttggtaattttaattagtgagcctcagattccaaaatcttgtcctgtgtttgatatccagttggtggctgattcagctttagtcagaatgtcttttgacgctgagttacagaagcttattctggagtatacaaatactgctacagcacttttatatgagatacttctggtctttcagcagggaaatctcggattgggatccacaaagtttgctattagctggataatgtcctttctacaaagctgtcctcccatcattacttttgtggccagtattgtgaaacaagtggtgaggggtctttcagcttcatttcagctgctaagtccctgccaagcagttctgttgtaccagcaattttacatcctcaagagctgtctgcggcacagcaggactctagctgagtatattaggaataactacagagaagaattcaggtactttattcacatgccagccttgcagaaaaggctcccattgtgttaccccatcactcaacctaccattcaactttttcatgaagttctgaaattggttgaatag

SEQ ID NO: 8075 - DNA, 2254 bp, synthetic construct; identical to SEQ ID NO: 8053
  misc_feature 1..2254: note = Synthetic polypeptide
  source 1..2254: mol_type = other DNA

SEQ ID NO: 8076 - DNA, 2044 bp, synthetic construct; identical to SEQ ID NO: 8054
  misc_feature 1..2044: note = Synthetic polypeptide
  source 1..2044: mol_type = other DNA

SEQ ID NO: 8077 - DNA, 1735 bp, synthetic construct; identical to SEQ ID NO: 8055
  misc_feature 1..1735: note = Synthetic polypeptide
  source 1..1735: mol_type = other DNA

SEQ ID NO: 8078 - DNA, 1154 bp, synthetic construct
  misc_feature 1..1154: note = Synthetic polypeptide
  source 1..1154: mol_type = other DNA
atttataacaacaaaaaggggaaacaactggaatgtccatcatctgatatgtgataagcaaaatgtggtatatccatacaatggaatattacttggctgtaaaaaggaatgaagtgtttacatttgccacatgatggatgaattttgaaacatttgaaggagctgaagaggaaaaaatggaagccgaccctgatggtcagcagcctgaaaaggcagaaaataaagtggaaaatgaaacggatgaaggtgataaagcacaagatggagaaaatgaaaaaaatagtgaaaaggaacaggatagtgaagtgagtgaggataccaaatcagaagaaaaggagactgaagagaacaaagaactcactgatacatgtaaagaaagagaaagtgatactgggaagaagaaagtagaacatgaaatttccgaaggaaatgttgccacagccgcagcagctgctcttgcctcagcggctaccaaagccaagcacctggctgcagtggaagaaagaaagatcaagtccctggtagctctcttggttgagacacaaatgaagaaactagagatcaaacttcgacattttgaagagctggaaactatcatggacagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttag

SEQ ID NO: 8079 - DNA, 534 bp, synthetic construct
  misc_feature 1..534: note = Synthetic polypeptide
  source 1..534: mol_type = other DNA
aaatgtgtacacgtatgtggaacacattaactaaaatggtaacagaatggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataa

SEQ ID NO: 8080 - DNA, 500 bp, synthetic construct
  misc_feature 1..500: note = Synthetic polypeptide
  source 1..500: mol_type = other DNA
aaatgtgtacacgtatgtggaacacattaactaaaatggtaacagaatggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgagaccagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgt

SEQ ID NO: 8081 - DNA, 453 bp, synthetic construct
  misc_feature 1..453: note = Synthetic polypeptide
  source 1..453: mol_type = other DNA
aaatgtgtacacgtatgtggaacacattaactaaaatggtaacagaatggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgagaccaggtgttgcttgttcagtatctcaagcccagaaagatgaattaatccttgaaggaaatgacattgagcttgtttcaaattcagcggctttgattcagcaagccacaaca

SEQ ID NO: 8082 - DNA, 1331 bp, synthetic construct; identical to SEQ ID NO: 550
  misc_feature 1..1331: note = Synthetic polypeptide
  source 1..1331: mol_type = other DNA

SEQ ID NO: 8083 - DNA, 1028 bp, synthetic construct; identical to SEQ ID NO: 551
  misc_feature 1..1028: note = Synthetic polypeptide
  source 1..1028: mol_type = other DNA

SEQ ID NO: 8084 - DNA, 1295 bp, synthetic construct; identical to SEQ ID NO: 553
  misc_feature 1..1295: note = Synthetic polypeptide
  source 1..1295: mol_type = other DNA

SEQ ID NO: 8085 - DNA, 1322 bp, synthetic construct; identical to SEQ ID NO: 554
  misc_feature 1..1322: note = Synthetic polypeptide
  source 1..1322: mol_type = other DNA

SEQ ID NO: 8086 - DNA, 1013 bp, synthetic construct; identical to SEQ ID NO: 555
  misc_feature 1..1013: note = Synthetic polypeptide
  source 1..1013: mol_type = other DNA

SEQ ID NO: 8087 - DNA, 1216 bp, synthetic construct; identical to SEQ ID NO: 6819
  misc_feature 1..1216: note = Synthetic polypeptide
  source 1..1216: mol_type = other DNA

SEQ ID NO: 8088 - DNA, 510 bp, synthetic construct; identical to SEQ ID NO: 6820
  misc_feature 1..510: note = Synthetic polypeptide
  source 1..510: mol_type = other DNA

SEQ ID NO: 8089 - DNA, 1807 bp, synthetic construct
  misc_feature 1..1807: note = Synthetic polypeptide
  source 1..1807: mol_type = other DNA
cagccttggattcagaagcccggctgcctgctaagctgtgtaattgccagatgcggtgacctgccagcacctgccgcagccttcgtccgggagtcgccccatctctccacgcatcggggccctgtgccccttgctgctgcagccgggcaccatgtcgacctcgtccttgaggcgccagatgaagaacatcgtccacaactactcagaggcggagatcaaggttcgagaggccacgagcaatgacccctggggcccatccagctccctcatgtcagagattgccgacctcacctacaacgttgtcgccttctcggagatcatgagcatgatctggaagcggctcaatgaccatggcaagaactggcgtcacgtttacaaggccatgacgctgatggagtacctcatcaagaccggctcggagcgcgtgtcgcagcagtgcaaggagaacatgtacgccgtgcagacgctgaaggacttccagtacgtggaccgcgacggcaaggaccagggcgtgaacgtgcgtgagaaagctaagcagctggtggccctgctgcgcgacgaggaccggctgcgggaagagcgggcgcacgcgctcaagaccaaggaaaagctggcacagaccgccacggcctcatcagcagctgtgggctcaggcccccctcccgaggcggagcaggcgtggccgcagagcagcggggaggaggagctgcagctccagctggccctggccatgagcaaggaggaggccgaccaggaggagcggatccgtcgcggggatgacctgcggctgcagatggcaatcgaggagagcaagagggagactgggggcaaggaggagtcgtccctcatggaccttgctgacgtcttcacggccccagctcctgccccgaccacagacccctgggggggcccagcacccatggctgctgccgtccccacggctgcccccacctcggacccctggggcggcccccctgtccctccagctgctgatccctggggaggtccagcccccacgccggcctctggggacccctggaggcctgctgcccctgcaggaccctcagttgacccttggggtgggaccccagcccctgcagctggggaggggcccacgcctgatccatggggaagttccgatggtggggtcccggtcagtgggccctcagcctccgatccctggacaccggccccggccttctcagatccctggggagggtcacctgccaagcccagcaccaatggcacaacagcagccgggggattcgacacggagcccgacgagttctctgactttgaccgactccgcacggcactgccgacctccgggagcagcgcaggagagctggagctgctggcaggagaggtgccggcccgaagccctggggcgtttgacatgagtggggtcaggggatctctggctgaggctgtgggcagccccccacctgcagccacaccaactcccacgccccccacccggaagacgccggagtcattcctggggcccaatgcagccctcgtcgacctggactcgctggtgagccggccgggccccacgccgcctggagccaaggcctccaaccccttcctgccaggcggaggcccagccactggcccttccgtcaccaaccccttccagcccgcgcctcccgcgacgctcaccctgaaccagctccgtctcagtcctgtgcctcccgtccctggagcgccacccacgtacatctctccccttggcgggggccctggcctgccccccatgatgcccccgggccccccggcccccaacactaatcccttcctcctataa

SEQ ID NO: 8090 - DNA, 1854 bp, synthetic construct; identical to SEQ ID NO: 6613
  misc_feature 1..1854: note = Synthetic polypeptide
  source 1..1854: mol_type = other DNA

SEQ ID NO: 8091 - DNA, 1325 bp, synthetic construct; identical to SEQ ID NO: 7686
  misc_feature 1..1325: note = Synthetic polypeptide
  source 1..1325: mol_type = other DNA

SEQ ID NO: 8092 - DNA, 1691 bp, synthetic construct; identical to SEQ ID NO: 7687
  misc_feature 1..1691: note = Synthetic polypeptide
  source 1..1691: mol_type = other DNA

SEQ ID NO: 8093 - DNA, 1541 bp, synthetic construct; identical to SEQ ID NO: 7688
  misc_feature 1..1541: note = Synthetic polypeptide
  source 1..1541: mol_type = other DNA

SEQ ID NO: 8094 - DNA, 414 bp, synthetic construct; identical to SEQ ID NO: 6481
  misc_feature 1..414: note = Synthetic polypeptide
  source 1..414: mol_type = other DNA

SEQ ID NO: 8095 - DNA, 1148 bp, synthetic construct; identical to SEQ ID NO: 436
  misc_feature 1..1148: note = Synthetic polypeptide
  source 1..1148: mol_type = other DNA

SEQ ID NO: 8096 - DNA, 1452 bp, synthetic construct; identical to SEQ ID NO: 7300
  misc_feature 1..1452: note = Synthetic polypeptide
  source 1..1452: mol_type = other DNA

SEQ ID NO: 8097 - DNA, 1149 bp, synthetic construct; identical to SEQ ID NO: 7301
  misc_feature 1..1149: note = Synthetic polypeptide
  source 1..1149: mol_type = other DNA

SEQ ID NO: 8098 - DNA, 1416 bp, synthetic construct; identical to SEQ ID NO: 7302
  misc_feature 1..1416: note = Synthetic polypeptide
  source 1..1416: mol_type = other DNA

SEQ ID NO: 8099 - DNA, 1443 bp, synthetic construct; identical to SEQ ID NO: 7303
  misc_feature 1..1443: note = Synthetic polypeptide
  source 1..1443: mol_type = other DNA

SEQ ID NO: 8100 - DNA, 1134 bp, synthetic construct; identical to SEQ ID NO: 7304
  misc_feature 1..1134: note = Synthetic polypeptide
  source 1..1134: mol_type = other DNA

SEQ ID NO: 8101 - DNA, 1089 bp, synthetic construct
  misc_feature 1..1089: note = Synthetic polypeptide
  source 1..1089: mol_type = other DNA
gggcgcggggcgcgccgccatgggcctggccgggctgcaggcaggaagatgtccaagccccgcgcggtggaggcggcggcggcggcggcggcggtggcagcgacggccccgggcccggagatggtggagcggaggggcccggggaggccccgcaccgacggggagaacgtatttaccgggcagtcaaagatctattcctacatgagcccgaacaaatgctctggaatgcgtttcccccttcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccaaaaactccaccctcatcttgtgattccaccaatgcagccatcgccaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaa

SEQ ID NO: 8102 - DNA, 299 bp, synthetic construct; identical to SEQ ID NO: 485
  misc_feature 1..299: note = Synthetic polypeptide
  source 1..299: mol_type = other DNA

SEQ ID NO: 8103 - DNA, 1503 bp, synthetic construct
  misc_feature 1..1503: note = Synthetic polypeptide
  source 1..1503: mol_type = other DNA
cagaccgcctggtaaatcccagctcctgagctgggtgacctggcctgtctacgtaacctctctgaacctcagtgtccttgtccatggaacagaaactagcccctcatccatctgtctctgattgcagtgacgtttgccatcgtcctcggcgtcatcatctacagaatctccatggccgccgccttggccatgaactcctccccctccgtgcggtccaacatccgggtcacagtcacagccaccgcagtcatcatcaacctagtggtcatcatcctcctggacgaggtgtatggctgcatagcccgatggctcaccaagatcgaggtcccaaagacggagaaaagctttgaggagaggctgatcttcaaggctttcctgctgaagtttgtgaattcctacacccccatcttttacgtggcgttcttcaaaggccggtttgttggacgcccgggcgactacgtgtacattttccgttccttccgaatggaagagtgtgcgccagggggctgcctgatggagctatgcatccagctcagcatcatcatgctggggaaacagctgatccagaacaacctgttcgagatcggcatcccgaagatgaagaagctcatccgctacctgaagctgaagcagcagagcccccctgaccacgaggagtgtgtgaagaggaaacagcggtacgaggtggattacaacctggagcccttcgcgggcctcaccccagagtacatggaaatgatcatccagtttggcttcgtcaccctgtttgtcgcctccttccccctggccccactgtttgcgctgctgaacaacatcatcgagatccgcctggacgccaaaaagtttgtcactgagctccgaaggccggtagctgtcagagccaaagacatcggaatctggtacaatatcctcagaggcattgggaagcttgctgtcatcatcaatgccttcgtgatctccttcacgtctgacttcatcccgcgcctggtgtacctctacatgtacagtaagaacgggaccatgcacggcttcgtcaaccacaccctctcctccttcaacgtcagtgacttccagaacggcacggcccccaatgaccccctggacctgggctacgaggtgcagatctgcaggtataaagactaccgagagccgccgtggtcggaaaacaagtacgacatctccaaggacttctgggccgtcctggcagcccggctggcgtttgtcatcgtcttccagaacctggtcatgttcatgagcgactttgtggactgggtcatcccggacatccccaaggacatcagccagcagatccacaaggagaaggtgctcatggtggagctgttcatgcgggaggagcaagacaagcagcagctgctggaaacctggatggagaaggagcggcagaaggacgagccgccgtgcaaccaccacaacaccaaagcctgcccagacagcctcggcagcccagcccccagccatgcctaccacgggggcgtcctgtag

SEQ ID NO: 8104 - DNA, 645 bp, synthetic construct
  misc_feature 1..645: note = Synthetic polypeptide
  source 1..645: mol_type = other DNA
cagaccgcctggtaaatcccagctcctgagctgggtgacctggcctgtctacgtaacctctctgaacctcagtgtccttgtccatggaacagaaactagcccctcatccatctgtctctgattgcagtgacgtttgccatcgtcctcggcgtcatcatctacagaatctccatggccgccgccttggccatgaactcctccccctccgtgcggtccaacatccgggtcacagtcacagccaccgcagtcatcatcaacctagtggtcatcatcctcctggacgaggtgtatggctgcatagcccgatggctcaccaagatcgaggtcccaaagacggagaaaagctttgaggagaggctgatcttcaaggctttcctgctgaagtttgtgaattcctacacccccatcttttacgtggcgttcttcaaaggccggtttgttggacgcccgggcgactacgtgtacattttccgttccttccgaatggaagaggtaaccgaaattttattcatctctggcagccccttctgtcttgcttacgatttgtctacaccatgcacttgggagaagcagctgcagcacatttgttcagcaaagagcagcaggtttctttccttcttgctggaaacttttctgttcccctga

SEQ ID NO: 8105 - DNA, 343 bp, synthetic construct
  misc_feature 1..343: note = Synthetic polypeptide
  source 1..343: mol_type = other DNA
cagaccgcctggtaaatcccagctcctgagctgggtgacctggcctgtctacgtaacctctctgaacctcagtgtccttgtccatggaacagaaactagcccctcatccatctgtctctgattgcagtgacgtttgccatcgtcctcggcgtcatcatctacagaatctccatggccgccgccttggccatgaactcctccccctccgtgcggtccaacatccgggtcacagtcacagccaccgcagtcatcatcaacctagtggtcatcatcctcctggacgaggtgtatggctgcatagcccgatggctcaccaagatcgaggtcccaaagacggagaaaa

SEQ ID NO: 8106 - DNA, 2588 bp, synthetic construct; identical to SEQ ID NO: 6741
  misc_feature 1..2588: note = Synthetic polypeptide
  source 1..2588: mol_type = other DNA

SEQ ID NO: 8107 - DNA, 1964 bp, synthetic construct; identical to SEQ ID NO: 6742
  misc_feature 1..1964: note = Synthetic polypeptide
  source 1..1964: mol_type = other DNA

SEQ ID NO: 8108 - DNA, 609 bp, synthetic construct
  misc_feature 1..609: note = Synthetic polypeptide
  source 1..609: mol_type = other DNA
gctgggcaccgtggctcaggcctgtaatcctagcactttgggagactgaagagggcggatcccttgaggtcaggagttcgagaccagccatggtgaaaccctatcccagttacttggggaggctgaggccaaagaatcgcttgaaccgggaggcgaaggatgcaggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaa

SEQ ID NO: 8109 - DNA, 320 bp, synthetic construct
  misc_feature 1..320: note = Synthetic polypeptide
  source 1..320: mol_type = other DNA
gctgggcaccgtggctcaggcctgtaatcctagcactttgggagactgaagagggcggatcccttgaggtcaggagttcgagaccagccatggtgaaaccctatcccagttacttggggaggctgaggccaaagaatcgcttgaaccgggaggcgaaggatgcaggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttacca

SEQ ID NO: 8110 - DNA, 3355 bp, synthetic construct
  misc_feature 1..3355: note = Synthetic polypeptide
  source 1..3355: mol_type = other DNA
cactctattctgtcatatgactatatgcgtgtggctgactctcccaccaaattgagacatcctcaagccaccatcagagactgatatgatgcctgagggaccatctttccctgtctgtagcacttttgtacaagaactctttcaagcgcaatacagatcttctttgacgtgtcctcattgtcagaaacagagcaacacttttgatcctttcctttgcatttctttgccaattcctctgccccacacaaggcctctctatgtcactgtagtgtatcaaggcaaatgttctcactgcatgaggattggtgtggccgtacctctgtctgggactgtcgccagacttcgggaagcagtgtctatggaaacaaagatccccactgatcagattgtgttaacagaaatgtactatgatgggttccatcgttccttttgtgatacagacgacctggaaacagtccatgaaagcgactgcatttttgcctttgagactcccgaaatatttaggcctgaaggaattctcagtcaaagaggaattcatttaaacaacaacctaaaccacttgaaatttggcttggattatcatagactgtcttctcctacacaaacagcagcaaagcaggggaaaatggattctcccacatcaagagcaggcagcgacaagattgtcctgttggtgtgtaaccgagcctgcactgggcaacaagggaaaagatttggactgccttttgtgctgcacttagagaagacaatagcttgggaccttctgcagaaggaaatcttggagaagatgaagtatttcttgaggcccacggtttgcattcaggtgtgtccattcagcttgcgtgtggtcagtgttgttggaataacatatttgctgccccaggaggagcagcccttgtgccacccaatagtagaaagggcattaaaatcttgtggaccaggtggcactgctcatgtgaaattagtagtcgagtgggacaaggagacaagagatttcttatttgtaaatactgaggatgagtatattcctgatgcagaaagtgttcgtctgcaaagggagcgtcatcatcagcctcaaacctgcactttatcccagtgtttccaactgtacaccaaagaggagcggcttgcccccgatgatgcctggcgttgcccacactgtaagcagctgcagcagggaagcattacgttaagcctctggactctgcctgatgtgcttattatacatctaaagagatttcggcaggaaggagacaggcgcatgaaacttcagaacatggtcaaattccccttgactggcctggacatgacacctcacgtggttaagaggagccagagcagctggagtttgccatcgcattggtccccgtggagacggccctatggactcgggagggaccctgaggactacatctatgacctgtatgctgtgtgcaatcaccatggcaccatgcaaggggggcactacacagcgtactgtaagaactctgtggacggcctctggtactgcttcgatgacagcgatgtgcagcagctgtcagaagatgaggtctgcacgcagacagcatacatcctcttctaccagaggcggacagccatcccgtcatggtcagccaacagctcggtggcaggctccacaagttcttccctgtgtgaacactgggtgagccggctcccgggcagcaagccagccagcgtgacctctgcagcttcctccagacgcacctccctggcgtcgctctctgagtccgtggagatgactggagaaaggagtgaagatgatggaggcttttcaactcgaccatttgtgagaagtgtccagcgtcagagtttgtcatccagatcttctgtcaccagccccttggccgtcaatgaaaattgcatgagaccttcatggtccctgtctgctaagctgcagatgcgctccaattctccatcccgattttcaggggattcgccaattcacagctctgcttccaccttggagaagattggggaggcagcagatgacaaggtctccatctcttgctttggtagcttgcggaacctttctagcagttaccaggaaccaagcgacagtcatagtcgccgtgagcacaaggctgtgggccgggcccctctggctgtcatggaaggcgtgttcaaagacgaatcggacacccgcagattgaactccagtgtcgtagatacacagagcaaacattcagcacaaggggaccgcctgcccccgctctctggtccatttgataacaataatcagatcgcttatgtggatcagagcgactccgtagacagctctccagtcaaagaggtgaaagcccccagccacccaggctcactcgcaaagaaaccagagagcacaactaagagatcccccagttccaaaggcacttctgagccagagaaaagcttgcggaaggggagaccagccttggcaagccaggagtcatccctttcaagtacatccccttcttctcctcttcctgtaaaagtctctctaaagccctcccgctcccgcagcaaagcagattcttcttccaggggcagtggacggcattcatcccctgcccctgcccaacccaaaaaggagtcatccccgaaatctcaggactccgtgtcatctccttcgccacagaagcagaagtcagcctcggccctcacctacactgcttcctccacatctgccaaaaaggcctcgggccctgccacaaggagccctttcccacctgggaagagcaggacttcagaccacagcttgagtagagagggctccagacaaagcttgggttctgacagagccagcgccacctccacctccaaacccaattcccctcgggtgagccaggcccgagcaggggagggcaggggggccgggaagcacgtgcggagctcctccatggccagcctgcgctcccccagcacaagcatcaagtctggtttgaagagggacagcaagtctgaggacaaggggctgtccttcttcaaatcagccttgagacagaaggaaacccggcgctcgacggatcttggcaagacagccttgctctctaaaaaggctggtgggagctctgttaagtctgtctgtaagaacaccggggacgacgaggcagagagaggccaccagcctccagcttcccagcagccaaatgcaaatacaacgggaaaagagcagcttgtcaccaaggaccctgcttctgccaaacattccctgctgtccgctcgcaaatccaagtcttcccaactagactctggagttccctcgtctccgggtggcaggcagtctgcagagaaatcctcaaaaaagttatcttctagcatgcaaacctctgcacggccttctcaaaaacctcagtga

SEQ ID NO: 8111 - DNA, 920 bp, synthetic construct
  misc_feature 1..920: note = Synthetic polypeptide
  source 1..920: mol_type = other DNA
aggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactga

SEQ ID NO: 8112 - DNA, 207 bp, synthetic construct; identical to SEQ ID NO: 7693
  misc_feature 1..207: note = Synthetic polypeptide
  source 1..207: mol_type = other DNA

SEQ ID NO: 8113 - DNA, 268 bp, synthetic construct; identical to SEQ ID NO: 7694
  misc_feature 1..268: note = Synthetic polypeptide
  source 1..268: mol_type = other DNA

SEQ ID NO: 8114 - DNA, 1931 bp, synthetic construct; identical to SEQ ID NO: 7491
  misc_feature 1..1931: note = Synthetic polypeptide
  source 1..1931: mol_type = other DNA

SEQ ID NO: 8115 - DNA, 1089 bp, synthetic construct
  misc_feature 1..1089: note = Synthetic polypeptide
  source 1..1089: mol_type = other DNA
ctgttgccgctatgcccacagtagtatttgttacataacaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctga

SEQ ID NO: 8116 - DNA, 483 bp, synthetic construct; identical to SEQ ID NO: 7323
  misc_feature 1..483: note = Synthetic polypeptide
  source 1..483: mol_type = other DNA

SEQ ID NO: 8117 - DNA, 374 bp, synthetic construct
  misc_feature 1..374: note = Synthetic polypeptide
  source 1..374: mol_type = other DNA
gctgctgtggtaagcagtttgatggaccctcaaaaagctaaacagcatttccatgtgacctggcaattcccttcctaggtatacactcaagagaactgaaaacaagtgctcaagcagaaacttgtacatgaatgttcatcccatcattattcacaatagccaaaaaattgaaacagcccaaatgctcatcagccaatgagtggagaaacaaaacatgtccacctaaacccactgtgttcatctctggggtcatcgcccggggtgacaaagatttccccccggcggctgcgcaggtggctcaccagaagccgcatgcctccatggacaagcatccttccccaagaacccagcacatccagcagccacgcaagtga

SEQ ID NO: 8118 - DNA, 3238 bp, synthetic construct
  misc_feature 1..3238: note = Synthetic polypeptide
  source 1..3238: mol_type = other DNA
gcagttctcaaagtgttggtatggacccttgggtgtgagctttcatgatgtaaaagattatattcaggaatatttgaccctgttaaaaaagaaagcattcataactgaagataaaactgaactgtacatgctcttcatcaactgcctggaggattcaatacttgagaagaccagtgcttactccagaaatgatgaactgaaccacctagaagaggaaggtcgtttccttaaggcatattctccagcaagccggggccgagagcctgccaacgaggcctcggttgaatacctgcaagaggtggcccggatccgcctctgcctcgacagagctgcagatttcctctcggagcctgagggaggcccagagatggccaaggagaagcagtgctacctgcagcaagtcaagcagttctgtatccgggtggagaacgactggcaccgggtgtacctggtgcggaagctcagcagccagcgggggatggagttcgtgcagggcctctccaagcccggccgcccgcaccagtgggtgtttcccaaggacgttgtcaagcagcaggggctgcggcaggaccacccaggccagatggataggtacctggtgtacggcgatgaatacaaggctctccgtgatgctgtggccaaagctgtcctcgagtgcaagccactgggcattaagactgctctgaaggcctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatggccattcatgctgcagccgtccttctgtgtggacagaatgaactcttggagcccctaaagaatctggccttctccccagccaccatggcgcatgcttttcttccaaccatgcctgaagacttgctggctcaagctcggaggtggaagggtctggagcgagtccactggtacacttgtcccaacggccatccttgctccgtgggagagtgtggcaggccgatggaacagagcatctgcattgactgccatgcgccgattggaggcattgaccacaaacctcgggacggctttcatctggtcaaagacaaggcagacagaacgcagaccggccacgtgctgggcaacccgcagcggagagacgtggtgacatgtgaccgagggctgcccccagtggtcttcctccttatccggctactcactcacttggctctgcttctgggagcgtcccagagttcccaggctctgataaacatcattaagcctccagtgagggatccaaaaggctttctgcagcagcacatcctgaaggacctggagcagttggccaagatgctgggacacagtgccgacgagaccatcggcgtggtccacctcgtcctgcgcaggcttctccaagagcagcaccagctctctagcagaaggcttttaaattttgacacagaattgtcaactaaagaaatgaggaacaactgggaaaaggaaatcgcagctgtgatttctcctgaactggagcatctagataaaacccttcccaccatgaataatctcatcagccaagataagcgtatcagctctaaccctgtggccaaaataatatatggtgacccagtgaccttcctgccccacctgccccggaaaagtgtggtccattgctctaagatttggagctgcaggaaaagaattacagttgagtacctccagcacattgtggaacagaaaaatggcaaagaaagagtgcccatcctctggcatttcctgcagaaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatag

SEQ ID NO: 8119 - DNA, 1224 bp, synthetic construct; identical to SEQ ID NO: 6690
  misc_feature 1..1224: note = Synthetic polypeptide
  source 1..1224: mol_type = other DNA

SEQ ID NO: 8120 - DNA, 873 bp, synthetic construct
  misc_feature 1..873: note = Synthetic polypeptide
  source 1..873: mol_type = other DNA
ggccaggtgaggtggctcacacctgtaatcccagcactttgggaggccaaggcaggcggatcacctgagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcctgggcagtgtgacgtttctggctggcaatcggatgctggcccagcaggcagtcaagagaacagcacattag

SEQ ID NO: 8121 - DNA, 921 bp, synthetic construct
  misc_feature 1..921: note = Synthetic polypeptide
  source 1..921: mol_type = other DNA
ggccaggtgaggtggctcacacctgtaatcccagcactttgggaggccaaggcaggcggatcacctgagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcctgggcagtgtgacgtttctggctggcaatcggatgctggcccagcaggcagtcaagaggatcgctgcagagcagagcagtagattggcaaaatataggacactacgaacagcacattag

SEQ ID NO: 8122 - DNA, 2537 bp, synthetic construct; identical to SEQ ID NO: 7357
  misc_feature 1..2537: note = Synthetic polypeptide
  source 1..2537: mol_type = other DNA

SEQ ID NO: 8123 - DNA, 1913 bp, synthetic construct; identical to SEQ ID NO: 7358
  misc_feature 1..1913: note = Synthetic polypeptide
  source 1..1913: mol_type = other DNA

SEQ ID NO: 8124 - DNA, 337 bp, synthetic construct; identical to SEQ ID NO: 6393
  misc_feature 1..337: note = Synthetic polypeptide
  source 1..337: mol_type = other DNA

SEQ ID NO: 8125 - DNA, 404 bp, synthetic construct; identical to SEQ ID NO: 7701
  misc_feature 1..404: note = Synthetic polypeptide
  source 1..404: mol_type = other DNA

SEQ ID NO: 8126 - DNA, 336 bp, synthetic construct; identical to SEQ ID NO: 7702
  misc_feature 1..336: note = Synthetic polypeptide
  source 1..336: mol_type = other DNA

SEQ ID NO: 8127 - DNA, 3325 bp, synthetic construct; identical to SEQ ID NO: 7703
  misc_feature 1..3325: note = Synthetic polypeptide
  source 1..3325: mol_type = other DNA

SEQ ID NO: 8128 - DNA, 169 bp, synthetic construct; identical to SEQ ID NO: 7704
  misc_feature 1..169: note = Synthetic polypeptide
  source 1..169: mol_type = other DNA

SEQ ID NO: 8129 - DNA, 169 bp, synthetic construct; identical to SEQ ID NO: 7705
  misc_feature 1..169: note = Synthetic polypeptide
  source 1..169: mol_type = other DNA

SEQ ID NO: 8130 - DNA, 241 bp, synthetic construct; identical to SEQ ID NO: 7706
  misc_feature 1..241: note = Synthetic polypeptide
  source 1..241: mol_type = other DNA

SEQ ID NO: 8131 - DNA, 273 bp, synthetic construct; identical to SEQ ID NO: 7707
  misc_feature 1..273: note = Synthetic polypeptide
  source 1..273: mol_type = other DNA

SEQ ID NO: 8132 - DNA, 329 bp, synthetic construct; identical to SEQ ID NO: 7708
  misc_feature 1..329: note = Synthetic polypeptide
  source 1..329: mol_type = other DNA

SEQ ID NO: 8133 - DNA, 203 bp, synthetic construct; identical to SEQ ID NO: 7709
  misc_feature 1..203: note = Synthetic polypeptide
  source 1..203: mol_type = other DNA

SEQ ID NO: 8134 - DNA, 271 bp, synthetic construct; identical to SEQ ID NO: 7710
  misc_feature 1..271: note = Synthetic polypeptide
  source 1..271: mol_type = other DNA

SEQ ID NO: 8135 - DNA, 297 bp, synthetic construct; identical to SEQ ID NO: 7711
  misc_feature 1..297: note = Synthetic polypeptide
  source 1..297: mol_type = other DNA

SEQ ID NO: 8136 - DNA, 127 bp, synthetic construct; identical to SEQ ID NO: 7712
  misc_feature 1..127: note = Synthetic polypeptide
  source 1..127: mol_type = other DNA

SEQ ID NO: 8137 - DNA, 289 bp, synthetic construct; identical to SEQ ID NO: 7343
  misc_feature 1..289: note = Synthetic polypeptide
  source 1..289: mol_type = other DNA

SEQ ID NO: 8138 - DNA, 246 bp, synthetic construct; identical to SEQ ID NO: 7344
  misc_feature 1..246: note = Synthetic polypeptide
  source 1..246: mol_type = other DNA

SEQ ID NO: 8139 - DNA, 149 bp, synthetic construct; identical to SEQ ID NO: 7345
  misc_feature 1..149: note = Synthetic polypeptide
  source 1..149: mol_type = other DNA

SEQ ID NO: 8140 - DNA, 89 bp, synthetic construct; identical to SEQ ID NO: 7346
  misc_feature 1..89: note = Synthetic polypeptide
  source 1..89: mol_type = other DNA

SEQ ID NO: 8141 - DNA, 80 bp, synthetic construct; identical to SEQ ID NO: 7347
  misc_feature 1..80: note = Synthetic polypeptide
  source 1..80: mol_type = other DNA

SEQ ID NO: 8142 - DNA, 1101 bp, synthetic construct
  misc_feature 1..1101: note = Synthetic polypeptide
  source 1..1101: mol_type = other DNA
ggccaggcacggtggctcacgcctgtaatcccggcacttggggaggccaaggcgggcagatcatgagaccggcctggccaacgtagtgaaatctctacataaaattagccaggtttggtggcgggtgcctgaaatcccagctactcgggaggctgaggcaggagaatcacttgaacccaggacatggagcgcctgtcagaggagctgctgctgccactgctgagtcagcccacactgggcagcctgtgggattcccttaggcactgctcccttctctgcaacccgctgtcctgtgtgccagcccttgaagctccccccagcctcgtgtcactgggctgctcgggaggctgcccccgtctcagtctggctggctcagcctcacccttcccattcctcactgccctcctctctcttcttaataccctggcccagatccacaaggggctgtgtggccagctggctgccatattggctgccccgggactccagaattacttcctccagtgtgtggctcctggggctgccccacacctcacacctttctctgcatgggccctgcgccatgagtaccacctgcagtacctggcactcgctctggcccagaaagcggcagcgctgcagccactgccagccacccatgctgccctctatcatggtatggccttggccctgctgagccggctgctgcccggaagtgagtacctcacccatgagctgctgctgagctgtgtattccggctggagttcctcccttgcctgtgtccctggagtgttacacagtgcctcctgaagacaacctggccctccttcagctctacttccggaccctggttactggtgcgctccgcccacgttggtgccccgtgctctatgctgtggctgtggctcatgtcaatagcttcatcttctctcaggacccacagagctcagatgaggtcaaagctgcccgcaggagtatgctgcagaaaacatggctgctggcagatgagggtctccggcagcacctcctgcactataagcttcccaattccacgctcccagagggctttgagctctattctcagttgccccctctgcgtcagcactacctccagagactga

SEQ ID NO: 8143 - DNA, 1896 bp, synthetic construct
  misc_feature 1..1896: note = Synthetic polypeptide
  source 1..1896: mol_type = other DNA
ggccaggcacggtggctcacgcctgtaatcccggcacttggggaggccaaggcgggcagatcatgagaccggcctggccaacgtagtgaaatctctacataaaattagccaggtttggtggcgggtgcctgaaatcccagctactcgggaggctgaggcaggagaatcacttgaacccaggacatggagcgcctgtcagaggagctgctgctgccactgctgagtcagcccacactgggcagcctgtgggattcccttaggcactgctcccttctctgcaacccgctgtcctgtgtgccagcccttgaagctccccccagcctcgtgtcactgggctgctcgggaggctgcccccgtctcagtctggctggctcagcctcacccttcccattcctcactgccctcctctctcttcttaataccctggcccagatccacaaggggctgtgtggccagctggctgccatattggctgccccgggactccagaattacttcctccagtgtgtggctcctggggctgccccacacctcacacctttctctgcatgggccctgcgccatgagtaccacctgcagtacctggcactcgctctggcccagaaagcggcagcgctgcagccactgccagccacccatgctgccctctatcatggtatggccttggccctgctgagccggctgctgcccggaagtgagtacctcacccatgagctgctgctgagctgtgtattccggctggagttcctcccggaaagaacatcagggggtccagaggcagccgacttctctgaccagctgtcgttaggaagcagcagggtccctcggtgtgggcaagggactctgctggctcaggcctgccaggacctccccagcatccgcaactgctacctgactcattgctcgccagcccgagccagtctgctggcctcccaggctctgcaccgaggggagctacagcgagtcccaaccctgctactgcccatgcctacggagccgctgctgcccaccgactggcccttcctgccactgattcgcctctaccaccgggcttcagacaccccctcgggactctctcccacagacaccatgggcacagccatgcgggtcctgcagtgggtgctagttttggagagctggcgcccccaggctctctgggctgtgccccctgctgcccgcctggcacggctcatgtgtgtgttcctggtggacagtgagctgttccgggagtccccagtacagcatctggtggcagccctcctcgcccagctctgtcagcctcaagtcttgccaaacctcaacctggactgccgactccctggcctgacgtctttccctgacctctatgccaacttcctggatcattttgaggctgtctcttttggggaccacctctttggggccctggtcctcctgcccctgcagcgtcggttcagtgtcaccttgcgccttgccctctttggggaacacgtgggagccttgcgagctctgagcctgcctctgacccagttgcctgtgtccctggagtgttacacagtgcctcctgaagacaacctggccctccttcagctctacttccggaccctggttactggtgcgctccgcccacgttggtgccccgtgctctatgctgtggctgtggctcatgtcaatagcttcatcttctctcaggacccacagagctcagatgaggtcaaagctgcccgcaggagtatgctgcagaaaacatggctgctggcagatgagggtctccggcagcacctcctgcactataagcttcccaattccacgctcccagagggctttgagctctattctcagttgccccctctgcgtcagcactacctccagagactgacttcaacagtgctccaaaatggggtatcagagacctag

SEQ ID NO: 8144 - DNA, 1662 bp, synthetic construct
  misc_feature 1..1662: note = Synthetic polypeptide
  source 1..1662: mol_type = other DNA
ggccaggcacggtggctcacgcctgtaatcccggcacttggggaggccaaggcgggcagatcatgagaccggcctggccaacgtagtgaaatctctacataaaattagccaggtttggtggcgggtgcctgaaatcccagctactcgggaggctgaggcaggagaatcacttgaacccaggacatggagcgcctgtcagaggagctgctgctgccactgctgagtcagcccacactgggcagcctgtgggattcccttaggcactgctcccttctctgcaacccgctgtcctgtgtgccagcccttgaagctccccccagcctcgtgtcactgggctgctcgggaggctgcccccgtctcagtctggctggctcagcctcacccttcccattcctcactgccctcctctctcttcttaataccctggcccagatccacaaggggctgtgtggccagctggctgccatattggctgccccgggactccagaattacttcctccagtgtgtggctcctggggctgccccacacctcacacctttctctgcatgggccctgcgccatgagtaccacctgcagtacctggcactcgctctggcccagaaagcggcagcgctgcagccactgccagccacccatgctgccctctatcatggtatggccttggccctgctgagccggctgctgcccggaagtgagtacctcacccatgagctgctgctgagctgtgtattccggctggagttcctcccggaaagaacatcagggggtccagaggcagccgacttctctgaccagctgtcgttaggaagcagcagggtccctcggtgtgggcaagggactctgctggctcaggcctgccaggacctccccagcatccgcaactgctacctgactcattgctcgccagcccgagccagtctgctggcctcccaggctctgcaccgaggggagctacagcgagtcccaaccctgctactgcccatgcctacggagccgctgctgcccaccgactggcccttcctgccactgattcgcctctaccaccgggcttcagacaccccctcgggactctctcccacagacaccatgggcacagccatgcgggtcctgcagtgggtgctagttttggagagctggcgcccccaggctctctgggctgtgccccctgctgcccgcctggcacggctcatgtgtgtgttcctggtggacagtgagctgttccgggagtccccagtacagcatctggtggcagccctcctcgcccagctctgtcagcctcaagtcttgccaaacctcaacctggactgccgactccctggcctgacgtctttccctgacctctatgccaacttcctggatcattttgaggctgtctcttttggggaccacctctttggggccctggtcctcctgcccctgcagcgtcggttcagtgtcaccttgcgccttgccctctttggggaacacgtgggagccttgcgagctctgagcctgcctctgacccaggtactttctcagcccagcaggacctgcaagggtaccctgcactgggcctcgggggcagtcctgagccttgaggagctttggaagacctcagcttcctcatcttacctcttgggggctttgaggggattaagagaatcaatgaaaagggcttaa

SEQ ID NO: 8145 - DNA, 161 bp, synthetic construct; identical to SEQ ID NO: 7668
  misc_feature 1..161: note = Synthetic polypeptide
  source 1..161: mol_type = other DNA

SEQ ID NO: 8146 - DNA, 178 bp, synthetic construct; identical to SEQ ID NO: 7669
  misc_feature 1..178: note = Synthetic polypeptide
  source 1..178: mol_type = other DNA

SEQ ID NO: 8147 - DNA, 619 bp, synthetic construct
  misc_feature 1..619: note = Synthetic polypeptide
  source 1..619: mol_type = other DNA
ggccaggcatggtggctcacgcctgtaatcccagcactttgggaggccgaggcgggcggatcacgaggagctgctgatggcgcacgacttcaccaagtttcactcgctgaagccgaagctgctagaggcactggacgagatgctgacgcacgacatcgccaagctcatgcccctgctgcggcaggaggagctggagagcaccgaggtgggcgtgcaggggggcgcttttgagggcacccacatgggcccgtttgtggagcggggacctgacgaggccatggaggacggcgaggagggctcggacgacgaggccgagtgggtggtgaccaaggacaagtccaaatacgacgagatcttctacaacctggcgcctgccgacggcaagctgagcggctccaaggccaagacctggatggtggggaccaagctccccaactcagtgctggggcgcatctggaagctcagcgatgtggaccgcgacggcatgctggatgatgaggagttcgcgctggccagccacctcatcgaggccaagctggaaggccacgggctgcccgccaacctgccccgtcgcctggtgccaccctccaagcgacgccacaagggctccgccgagtga

SEQ ID NO: 8148 - DNA, 520 bp, synthetic construct; identical to SEQ ID NO: 6424
  misc_feature 1..520: note = Synthetic polypeptide
  source 1..520: mol_type = other DNA

SEQ ID NO: 8149 - DNA, 740 bp, synthetic construct
  misc_feature 1..740: note = Synthetic polypeptide
  source 1..740: mol_type = other DNA
ttatgaattccattgtgtcctccacccccaaggataggttgggatcctgaacccccatccctcagcatgtgacttcatttagagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggctctggtgtgactgtcaacgccctgcaccccggcgtggccaggacagagctgggcagacacacgggcatccatggctccaccttctccagcaccacactcgggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataa

SEQ ID NO: 8150 - DNA, 407 bp, synthetic construct
  misc_feature 1..407: note = Synthetic polypeptide
  source 1..407: mol_type = other DNA
ttatgaattccattgtgtcctccacccccaaggataggttgggatcctgaacccccatccctcagcatgtgacttcatttagagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggctga

SEQ ID NO: 8151 - DNA, 486 bp, synthetic construct; identical to SEQ ID NO: 7296
  misc_feature 1..486: note = Synthetic polypeptide
  source 1..486: mol_type = other DNA

SEQ ID NO: 8152 - DNA, 2738 bp, synthetic construct
  misc_feature 1..2738: note = Synthetic polypeptide
  source 1..2738: mol_type = other DNA
tttccacggtctccctctcatgccgagccgaagctggacggtactgctgccatctcggctcactgcaacctccctgcctgattctcctgcctcagcttgccgagtgcctgcgattgcaggtgcacgccgccacgcctgactggttttcgtattttcttggtggagactgggattcgctgtgttggccgggctggtctccagctcctaaccgcgagtgatccgacagcctcggcctcccgaggtgccgggattgcagacggagtctcgttcattcagtgctcaatggtgcccaggctggagtgcagtggcgtgatcttggctcgtgcaacctccacctcccagcagcctgccttggcctcccaaagtgccgagattgcagcctctgcccggccgccaccccgtctgggaagtgaggagcttctccgcctggccgcctatcgtctgggatgtgaggagcccctctgcctggctgcccagtctggaaagtgaggagcgtctctacccggccgccatcccatctaggaagtgaggagcgcctcttcccggccaccatcacatctgggaagtgaggagcgtctctgccctgccgcccatcgtctgagatgtggggagcacctctgccctgccgccccgtccgggatgtgaggagcgtctctgcccggacgccccgtctgagaagtgaggagaccctctgcctggcaaccgccccgtctgagaagtgaggagcccctccgcccggcagccgccccgtctgagaatgccctgaggagctgaaacccatgaaggatggctctggctgctacgaccactccaaaggcattgactgctctgatggctttaatggcggctgtgagcagctgtgcctgcagcagacgctgcccctgccctacgatgccacttcgagcaccatcttcatgttctgcggttgcgtggaggagtacaaactggctcctgatggaaaatcctgcttaatgctctcagatgtctgcgagggccccaagtgcctcaaacctgactccaaattcaatgataccctctttggagagatgctacatggttacaacaaccggacccagcatgtgaaccaaggccaagtcttccagatgacctttagggagaacaacttcatcaaggactttccccagctggccgatgggctgttggtgatcccgctgccggtggaggagcagtgccggggggtcctctccgagccccttccagacctccaactgctcactggagatatcaggtatgatgaggccatgggttaccccatggtgcagcagtggcgggtccggagcaacctctaccgtgtgaagctcagcaccatcaccctcgcagcaggcttcactaatgttctcaagatcctgaccaaggagagcagtcgggaggagctgctgtccttcatccagcactatggctcccactacatcgcagaggccctctatggctcagagctcacctgcatcatccactttcccagcaagaaggtccagcagcagctgtggctccagtatcagaaagagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacgtacggggagtccaagggccggtga

SEQ ID NO: 8153 - DNA, 252 bp, synthetic construct
  misc_feature 1..252: note = Synthetic polypeptide
  source 1..252: mol_type = other DNA
gccaggtgcagtggctcacgcctgtaatccagcactttgggaggcggaggcaggtggatcacgaggtcaggagatcgagaccatcctggctaacacgtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaa

SEQ ID NO: 8154 - DNA, 594 bp, synthetic construct; identical to SEQ ID NO: 455
  misc_feature 1..594: note = Synthetic polypeptide
  source 1..594: mol_type = other DNA

SEQ ID NO: 8155 - DNA, 1031 bp, synthetic construct; identical to SEQ ID NO: 456
  misc_feature 1..1031: note = Synthetic polypeptide
  source 1..1031: mol_type = other DNA

SEQ ID NO: 8156 - DNA, 643 bp, synthetic construct
  misc_feature 1..643: note = Synthetic polypeptide
  source 1..643: mol_type = other DNA
ggctggtcacggtggctcaagcctgtaatcccagcacttggggaggccgaggccggtggatcacctgaggtcgggagttcgagatcagcctgaccaacatggagaaaccccgtctctactaaaactacaaaaaattagccgggtgtcgtgacgtgtgcctgtaatcccagctactcaggaggctgaggaggccaacggtcctgctgatggctacgcagccattgcccaggctgacaggctgacccaggagcctgagagcatccgcaagtggcgagaggagcagaggaaacggctgcaagagctggatgctgcatctaaggtcacggaacaggaatggcgggagaaggccaagaaggacctggaggagtggaaccagcgccagagtgaacaagtagagaagaacaagatcaacaaccggatcgctgacaaagcattctaccagcagccagatgctgatatcatcggctacgtggcatccgaggaggctttcgtgaaggaatccaaggaggagaccccaggcacagagtgggagaaggtggcccagctatgtgacttcaaccccaagagcagcaagcagtgcaaagatgtgtcccgcctgcgctcggtgctcatgtccctgaagcagacgccactgtcccgctag

SEQ ID NO: 8157 - DNA, 589 bp, synthetic construct
  misc_feature 1..589: note = Synthetic polypeptide
  source 1..589: mol_type = other DNA
ggctggtcacggtggctcaagcctgtaatcccagcacttggggaggccgaggccggtggatcacctgaggtcgggagttcgagatcagcctgaccaacatggagaaaccccgtctctactaaaactacaaaaaattagccgggtgtcgtgacgtgtgcctgtaatcccagctactcaggaggctgaggaggccaacggtcctgctgatggctacgcagccattgcccaggctgacaggctgacccaggagcctgagagcatccgcaagtggcgagaggagcagaggaaacggctgcaagagctggatgctgcatctaaggtcacggaacaggaatggcgggagaaggccaagaaggacctggaggagtggaaccagcgccagagtgaacaagtagagaagaacaagatcaacaaccgggcatccgaggaggctttcgtgaaggaatccaaggaggagaccccaggcacagagtgggagaaggtggcccagctatgtgacttcaaccccaagagcagcaagcagtgcaaagatgtgtcccgcctgcgctcggtgctcatgtccctgaagcagacgccactgtcccgctag

SEQ ID NO: 8158 - DNA, 301 bp, synthetic construct
  misc_feature 1..301: note = Synthetic polypeptide
  source 1..301: mol_type = other DNA
ggctggtcacggtggctcaagcctgtaatcccagcacttggggaggccgaggccggtggatcacctgaggtcgggagttcgagatcagcctgaccaacatggagaaaccccgtctctactaaaactacaaaaaattagccgggtgtcgtgacgtgtgcctgtaatcccagctactcaggaggctgaggaggccaacggtcctgctgatggctacgcagccattgcccaggctgacaggctgacccaggagcctgagagcatccgcaagtggcgagaggagcagaggaaacggctttcgtga

SEQ ID NO: 8159 - DNA, 895 bp, synthetic construct
  misc_feature 1..895: note = Synthetic polypeptide
  source 1..895: mol_type = other DNA
tggacttccattggtttaattaaaagtagtcaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaa

SEQ ID NO: 8160 - DNA, 1063 bp, synthetic construct
  misc_feature 1..1063: note = Synthetic polypeptide
  source 1..1063: mol_type = other DNA
tggacttccattggtttaattaaaagtagtcaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaa

SEQ ID NO: 8161 - DNA, 369 bp, synthetic construct; identical to SEQ ID NO: 7297
  misc_feature 1..369: note = Synthetic polypeptide
  source 1..369: mol_type = other DNA

SEQ ID NO: 8162 - DNA, 5196 bp, synthetic construct
  misc_feature 1..5196: note = Synthetic polypeptide
  source 1..5196: mol_type = other DNA
aatatggaggctttggagtcaggctacccaggttctaatctcagctctgtcacttactgtatgaccttgagcaagttactttattaccatgggttttcagtttccttacctataaaatgagaataataatagtactttaatttataggttaatgctgggggctcagtgagttgctgcatataaagtccctgacaatagtcagggttcaataaaggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtttttcagaaacgcatggcagagtcaggctttctcactgaaggggagatggccctgatttttgttaactggaaggagctcatcatgtccaacacaaagctgctgaaggctttgcgggtgcggaagaagaccgggggcgagaagatgccggtgcagatgattggggacatcctggccgctgagctgtcccacatgcaggcttacatcaggttctgcagctgccagcttaatggagcagctctgttacagcagaagacagatgaagacacagatttcaaagaatttttaaagaagctggcatctgacccgcggtgtaaaggaatgcccctctccagcttcctgctgaaacccatgcagaggatcacccgctacccactgctcatcagaagtattctggagaacaccccggagagccatgcagaccattcctccctaaagctggccctcgagcgggcagaggagctgtgctctcaagtgaatgagggagttcgggagaaggaaaactcggaccgactggagtggatccaggcgcacgtgcagtgtgaaggcctcgcggagcaacttattttcaactctctcaccaactgcctggggccccggaagctcttacacagtgggaaattatacaagaccaagagcaacaaggaactgcacggattcctcttcaatgacttcctgcttcttacctacatggtcaagcagtttgctgtttcctctggctctgagaaacttttcagctcgaagtccaatgctcaattcaaaatgtataaaacgcccattttcctgaatgaagtcttggtgaaactgcccacagacccttccagcgatgagcctgtcttccacatttcccacattgatcgggtctacaccctccgaacagacaacattaatgagaggaccgcctgggtgcagaagatcaaggcggcgtctgagcagtacatcgacaccgagaagaagaagcgtgagaaagcttaccaagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatgatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaactctcctgtag

SEQ ID NO: 8163 - DNA, 5277 bp, synthetic construct
  misc_feature 1..5277: note = Synthetic polypeptide
  source 1..5277: mol_type = other DNA
aatatggaggctttggagtcaggctacccaggttctaatctcagctctgtcacttactgtatgaccttgagcaagttactttattaccatgggttttcagtttccttacctataaaatgagaataataatagtactttaatttataggttaatgctgggggctcagtgagttgctgcatataaagtccctgacaatagtcagggttcaataaaggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaagtgtgggaatatggatgactctgttcttcagtgccttttgtctctgctaagctgtctcaacaacctcttcctcttacttaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtttttcagaaacgcatggcagagtcaggctttctcactgaaggggagatggccctgatttttgttaactggaaggagctcatcatgtccaacacaaagctgctgaaggctttgcgggtgcggaagaagaccgggggcgagaagatgccggtgcagatgattggggacatcctggccgctgagctgtcccacatgcaggcttacatcaggttctgcagctgccagcttaatggagcagctctgttacagcagaagacagatgaagacacagatttcaaagaatttttaaagaagctggcatctgacccgcggtgtaaaggaatgcccctctccagcttcctgctgaaacccatgcagaggatcacccgctacccactgctcatcagaagtattctggagaacaccccggagagccatgcagaccattcctccctaaagctggccctcgagcgggcagaggagctgtgctctcaagtgaatgagggagttcgggagaaggaaaactcggaccgactggagtggatccaggcgcacgtgcagtgtgaaggcctcgcggagcaacttattttcaactctctcaccaactgcctggggccccggaagctcttacacagtgggaaattatacaagaccaagagcaacaaggaactgcacggattcctcttcaatgacttcctgcttcttacctacatggtcaagcagtttgctgtttcctctggctctgagaaacttttcagctcgaagtccaatgctcaattcaaaatgtataaaacgcccattttcctgaatgaagtcttggtgaaactgcccacagacccttccagcgatgagcctgtcttccacatttcccacattgatcgggtctacaccctccgaacagacaacattaatgagaggaccgcctgggtgcagaagatcaaggcggcgtctgagcagtacatcgacaccgagaagaagaagcgtgagaaagcttaccaagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatgatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaactctcctgtag

SEQ ID NO: 8164 - DNA, 3933 bp, synthetic construct
  misc_feature 1..3933: note = Synthetic polypeptide
  source 1..3933: mol_type = other DNA
aatatggaggctttggagtcaggctacccaggttctaatctcagctctgtcacttactgtatgaccttgagcaagttactttattaccatgggttttcagtttccttacctataaaatgagaataataatagtactttaatttataggttaatgctgggggctcagtgagttgctgcatataaagtccctgacaatagtcagggttcaataaaggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaagtgtgggaatatggatgactctgttcttcagtgccttttgtctctgctaagctgtctcaacaacctcttcctcttacttaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtgaggaggctgctgctggctagctctcggggtatctgctgtctctcatga

SEQ ID NO: 8165 - DNA, 2010 bp, synthetic construct
  misc_feature 1..2010: note = Synthetic polypeptide
  source 1..2010: mol_type = other DNA
aatatggaggctttggagtcaggctacccaggttctaatctcagctctgtcacttactgtatgaccttgagcaagttactttattaccatgggttttcagtttccttacctataaaatgagaataataatagtactttaatttataggttaatgctgggggctcagtgagttgctgcatataaagtccctgacaatagtcagggttcaataaaggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtaggagctggagctcaggtagtagtgctcactcacctgccactcaccgagccccgctgtccagcccggttcctaacagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaa

SEQ ID NO: 8166 - DNA, 272 bp, synthetic construct
  misc_feature 1..272: note = Synthetic polypeptide
  source 1..272: mol_type = other DNA
ggccgggcgtggtggctcatgcctgtaatcccagcactttgggaggctgagaaaagaatggtttgtcattcattgaaacttcggccctagactctacaaatgtagaagctgcttttcagacaattttaacagagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaa

SEQ ID NO: 8167 - DNA, 89 bp, synthetic construct
  misc_feature 1..89: note = Synthetic polypeptide
  source 1..89: mol_type = other DNA
ggccgggcgtggtggctcatgcctgtaatcccagcactttgggaggctgagaaaagaatgaagcaaatgtcagacagacgcgaaaatga

SEQ ID NO: 8168 - DNA, 223 bp, synthetic construct
  misc_feature 1..223: note = Synthetic polypeptide
  source 1..223: mol_type = other DNA
ggccgggcgtggtggctcatgcctgtaatcccagcactttgggaggctgagaaaagaatggtttgtcattcattgaaacttcggccctagactctacaaatgtagaagctgcttttcagacaattttaacagagatttaccgcattgtttctcagaagcaaatgtcagacagacgcgaaaatgacatgtctccaagcaacaatgtggttcctattcatgttcc

SEQ ID NO: 8169 - DNA, 2983 bp, synthetic construct
  misc_feature 1..2983: note = Synthetic polypeptide
  source 1..2983: mol_type = other DNA
gctctcatctgggggcagttgtgtccccaggtggcatctggcaacatctgaagacatttttggctgccacggctgggcagggggtgctgttggcattgagtaggtgagctgctccccggtgtctgcccagctcctgtcggtgctgcagggcctcctgcacctggagcccaccctccgctccagccagctgctctgggaggccctggagagcctcgtgaaccgggccgtgctcctggccagcgatgcccaggaatgcaccctggaggaagtggttgagcggctcctgtctgtcaaggggcgacccagaccgagccccctggtcaaggcccataaaagcgtccaggccaacctagaccagagccagaggggcagctccccgcaaaacactacaacccccaagcccagcgtggagggccagcagccagcagcagctgctgcctgcgagcccgtggaccacgcccagagtgagagcatcctgaaagtttcgcagcccagagccctggagcagcaggcgtccaccccacccccacccccacccccacccctgctccctggttccagtgccgagccccctccccctcccccaccaccccccctgcccagtgtgggggctaaggccctcccaacagcacccccgcccccacccctgccaggcctgggggccatggcccccccagcacctcctctaccaccacccctgccaggctcctgtgagttcctgcccccaccacctccaccactcccgggcttgggatgcccgcccccacccccacccctgctgcctggtatgggctggggccctcctccacccccacctccactactgccctgcacctgcagcccccccgtggcgggaggcatggaggaggtcatcgtggcccaggtggaccatggcttgggctcagcatgggtccccagccatcggcgggtgaacccacccacactgcgcatgaagaagctgaactggcagaagctgccatccaacgtggcacgtgagcacaactctatgtgggcgtccctgagcagccccgacgccgaggctgtggagcccgacttctccagcatcgagcgactattctccttccctgcagccaagcccaaggagcccaccatggtggccccccgggccaggaaggagcccaaggagatcactttcctcgatgccaagaagagcctgaacctcaacatcttcctgaagcaatttaagtgctccaacgaggaggtcgctgctatgatccgggctggagataccaccaagtttgatgtggaggttctcaaacaactccttaagctccttcccgagaagcacgagattgaaaacctgcgggcattcacagaggagcgagccaagctggccagcgccgaccacttctacctcctcctgctggccattccctgctaccagctgcgaatcgagtgcatgctgctgtgtgagggcgcggccgccgtgctggacatggtgcggcccaaggcccagctggtgctggctgcctgcgaaagcctgctcaccagccgccagctgcccatcttctgccagctgatcctgagaattgggaacttcctcaactacggcagccacaccggtgacgccgacggcttcaagatcagcacattgctgaagctcacggagaccaagtcccagcagaaccgcgtgacgctgctgcaccacgtgctggaggaagcggaaaagagccaccccgacctcctgcagctgccccgggacctggaacagccctcgcaagcagcagggatcaacctggagatcatccgctcagaggccagctccaacctgaagaagcttctggagaccgagcggaaggtgtctgcctccgtggccgaggtccaggagcagtacaccgagcgcctccaggccagcatctcggccttccgggcactggatgagctgtttgaggccatcgagcagaagcaacgggagctggccgactacctgtgtgaggacgcccagcagctgtccctggaggacacgttcagcaccatgaaggctttccgggaccttttcctccgcgccctgaaggagaacaaggaccggaaggagcaggcggcgaaggcagagaggaggaagcagcagctggcggaggaggaggcgcggcggcctcggggagaggacgggaagcctgtcaggaaggggcccgggaagcaggaggaggtgtgtgtcatcgatgccctgctggctgacatcaggaagggcttccagctgcggaagacagcccggggccgcggggacaccgacgggggcagcaaggcagcctccatggatcccccaagagccacagagcctgtggccaccagtaaccctgcaggagatcccgtgggcagcacgcgctgtcccgcctctgagcccggccttgatgctacaacagccagcgagtcccggggctgggaccttgtagacgccgtgacccccggccctcagcccaccctggagcagttggaggagggtggtccacggcccctggagaggcgttcttcctggtatgtggatgccagcgatgtcctaaccactgaggatccccagtgcccccagcccttggagggggcctggccggtgactctgggagatgctcaggccctgaagcccctcaagttctccagcaaccagccccctgcagccggaagttcaaggcaagatgccaaggatcccacgtccttgctgggcgtcctccaggccgaggccgacagcacaagtgaggggctggaggacgctgtccacagccgtggtgccagaccccctgcagcaggcccaggtggggatgaggacgaggacgaggaggacacggccccagagtccgcactggacacatccctggacaagtccttctccgaggatgcggtgaccgactcctcggggtcgggcacactccccagggcccggggccgggcctcaaaggggaccgggaagcgaaggaagaagcgtccctccaggagccaggaaggcctcaggcccaggcccaaggccaagtga

SEQ ID NO: 8170 - DNA, 3010 bp, synthetic construct
  misc_feature 1..3010: note = Synthetic polypeptide
  source 1..3010: mol_type = other DNA
gctctcatctgggggcagttgtgtccccaggtggcatctggcaacatctgaagacatttttggctgccacggctgggcagggggtgctgttggcattgagtaggtgagctgctccccggtgtctgcccagctcctgtcggtgctgcagggcctcctgcacctggagcccaccctccgctccagccagctgctctgggaggccctggagagcctcgtgaaccgggccgtgctcctggccagcgatgcccaggaatgcaccctggaggaagtggttgagcggctcctgtctgtcaaggggcgacccagaccgagccccctggtcaaggcccataaaagcgtccaggccaacctagaccagagccagaggggcagctccccgcaaaacactacaacccccaagcccagcgtggagggccagcagccagcagcagctgctgcctgcgagcccgtggaccacgcccagagtgagagcatcctgaaagtttcgcagcccagagccctggagcagcaggcgtccaccccacccccacccccacccccacccctgctccctggttccagtgccgagccccctccccctcccccaccaccccccctgcccagtgtgggggctaaggccctcccaacagcacccccgcccccacccctgccaggcctgggggccatggcccccccagcacctcctctaccaccacccctgccaggctcctgtgagttcctgcccccaccacctccaccactcccgggcttgggatgcccgcccccacccccacccctgctgcctggtatgggctggggccctcctccacccccacctccactactgccctgcacctgcagcccccccgtggcgggaggcatggaggaggtcatcgtggcccaggtggaccatggcttgggctcagcatgggtccccagccatcggcgggtgaacccacccacactgcgcatgaagaagctgaactggcagaagctgccatccaacgtggcacgtgagcacaactctatgtgggcgtccctgagcagccccgacgccgaggctgtggagcccgacttctccagcatcgagcgactattctccttccctgcagccaagcccaaggagcccaccatggtggccccccgggccaggaaggagcccaaggagatcactttcctcgatgccaagaagagcctgaacctcaacatcttcctgaagcaatttaagtgctccaacgaggaggtcgctgctatgatccgggctggagataccaccaagtttgatgtggaggttctcaaacaactccttaagctccttcccgagaagcacgagattgaaaacctgcgggcattcacagaggagcgagccaagctggccagcgccgaccacttctacctcctcctgctggccattccctgctaccagctgcgaatcgagtgcatgctgctgtgtgagggcgcggccgccgtgctggacatggtgcggcccaaggcccagctggtgctggctgcctgcgaaagcctgctcaccagccgccagctgcccatcttctgccagctgatcctgagaattgggaacttcctcaactacggcagccacaccggtgacgccgacggcttcaagatcagcacattgctgaagctcacggagaccaagtcccagcagaaccgcgtgacgctgctgcaccacgtgctggaggaagcggaaaagagccaccccgacctcctgcagctgccccgggacctggaacagccctcgcaagcagcagggatcaacctggagatcatccgctcagaggccagctccaacctgaagaagcttctggagaccgagcggaaggtgtctgcctccgtggccgaggtccaggagcagtacaccgagcgcctccaggccagcatctcggccttccgggcactggatgagctgtttgaggccatcgagcagaagcaacgggagctggccgactacctgtgtgaggacgcccagcagctgtccctggaggacacgttcagcaccatgaaggctttccgggaccttttcctccgcgccctgaaggagaacaaggaccggaaggagcaggcggcgaaggcagagaggaggaagcagcagctggcggaggaggaggcgcggcggcctcggggagaggacgggaagcctgtcaggaaggggcccgggaagcaggaggaggtgtgtgtcatcgatgccctgctggctgacatcaggaagggcttccagctgcggaagacagcccggggccgcggggacaccgacgggggcagcaaggcagcctccatggatcccccaagagccacagagcctgtggccaccagtaaccctgcaggagatcccgtgggcagcacgcgctgtcccgcctctgagcccggccttgatgctacaacagccagcgagtcccggggctgggaccttgtagacgccgtgacccccggccctcagcccaccctggagcagttggaggagggtggtccacggcccctggagaggcgttcttcctggtatgtggatgccagcgatgtcctaaccactgaggatccccagtgcccccagcccttggagggggcctggccggtgactctgggagatgctcaggccctgaagcccctcaagttctccagcaaccagccccctgcagccggaagttcaaggcaagatgccaaggatcccacgtccttgctgggcgtcctccaggccgaggccgacagcacaagtgaggggctggaggacgctgtccacagccgtggtgccagaccccctgcagcaggcccaggtggggatgaggacgaggacgaggaggacacggccccagagtccgcactggacacatccctggacaagtccttctccgaggatgcggtgaccgactcctcggggtcgggcacactccccagggcccggggccgggcctcaaaggggaccgggaagcgaaggaagaagcgtccctccaggagccaggaagaggttccccctgattctgatgataataaaacaaagaaactgtgtgtgatccagtaa

SEQ ID NO: 8171 - DNA, 3621 bp, synthetic construct
  misc_feature 1..3621: note = Synthetic polypeptide
  source 1..3621: mol_type = other DNA
ggccgggcgcagtggctcatgcctgttatcctggcactttgggaggctgaggcgagcagatcacctgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaaggctgaggacctggacttctggctgtctaccaccccaccgcctgcccccgcccccgcccccgcccccgttccatccacgggggagctcagtgtgaacactgtcactaccccgaaggacgagtgtgaggacgccaagacggaggcgcagggcgaggaggacgatgccgaggggcaagaccaggacaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttga

SEQ ID NO: 8172 - DNA, 3312 bp, synthetic construct
  misc_feature 1..3312: note = Synthetic polypeptide
  source 1..3312: mol_type = other DNA
ggccgggcgcagtggctcatgcctgttatcctggcactttgggaggctgaggcgagcagatcacctgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaaggctgaggacctggacttctggctgtctaccaccccaccgcctgcccccgcccccgcccccgcccccgttccatccacggacgagtgtgaggacgccaagacggaggcgcagggcgaggaggacgatgccgaggggcaagaccaggacaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttga

SEQ ID NO: 8173 - DNA, 2928 bp, synthetic construct
  misc_feature 1..2928: note = Synthetic polypeptide
  source 1..2928: mol_type = other DNA
ggccgggcgcagtggctcatgcctgttatcctggcactttgggaggctgaggcgagcagatcacctgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatcctgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttga

SEQ ID NO: 8174 - DNA, 3435 bp, synthetic construct
  misc_feature 1..3435: note = Synthetic polypeptide
  source 1..3435: mol_type = other DNA
ggccgggcgcagtggctcatgcctgttatcctggcactttgggaggctgaggcgagcagatcacctgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttga

SEQ ID NO: 8175 - DNA, 895 bp, synthetic construct; identical to SEQ ID NO: 8159
  misc_feature 1..895: note = Synthetic polypeptide
  source 1..895: mol_type = other DNA

SEQ ID NO: 8176 - DNA, 851 bp, synthetic construct
  misc_feature 1..851: note = Synthetic polypeptide
  source 1..851: mol_type = other DNA
ctccttccacggtctccctctgatgccgagccaaagctggacggtactgctgccatctcggctcactgcaacctccctgcctgattctcctgcctcagcctgccgagtgcctgcgcacgccgccacgcctgactggttttcgttttttttttttggtggagacggggttttgctgtgttggccgggctggtctccagctcctgaccgcgagtgatccgccggcctcggcctcccgaggtgccgggattgcggacggagtctcgttcactcggtgctcggtggtgcccaggctggagtgcagtggcgtgatctcggctcgctacaacctccacctcccagccgcctgccttggccccccaaagtgccgagattgcagcctctgcccggccgccaccccgtctgggaagtgaggagcgtctctgcctggccccccatcgtctgggatatgaggagcctctctgcctggctgcccagtctggagggtgaggagcgtctctgcccggccgccatcccatctaggaggcgaggagcgcctcttccccgccgccatcccatctaggaagtgaggagcgtctctgcccggccgcccatcgtctgagatgtggggagcacctctgccccgccgccctgtctgggatgtgaggagcgcctctgctgggccgcaaccctgtctgggaggtgaggagtgtctctgcccggccgccccgtctgagagacatgtagactgccaaagtgtatgggatgctttcaagggtgcatttatttcaaaacatccttgcaacattactgaagaagactatcagccactaatgaagttgggaactcagaccgtaccttgcaacaagaaataa

SEQ ID NO: 8177 - DNA, 1385 bp, synthetic construct
  misc_feature 1..1385: note = Synthetic polypeptide
  source 1..1385: mol_type = other DNA
ctccttccacggtctccctctgatgccgagccaaagctggacggtactgctgccatctcggctcactgcaacctccctgcctgattctcctgcctcagcctgccgagtgcctgcgcacgccgccacgcctgactggttttcgttttttttttttggtggagacggggttttgctgtgttggccgggctggtctccagctcctgaccgcgagtgatccgccggcctcggcctcccgaggtgccgggattgcggacggagtctcgttcactcggtgctcggtggtgcccaggctggagtgcagtggcgtgatctcggctcgctacaacctccacctcccagccgcctgccttggccccccaaagtgccgagattgcagcctctgcccggccgccaccccgtctgggaagtgaggagcgtctctgcctggccccccatcgtctgggatatgaggagcctctctgcctggctgcccagtctggagggtgaggagcgtctctgcccggccgccatcccatctaggaggcgaggagcgcctcttccccgccgccatcccatctaggaagtgaggagcgtctctgcccggccgcccatcgtctgagatgtggggagcacctctgccccgccgccctgtctgggatgtgaggagcgcctctgctgggccgcaaccctgtctgggaggtgaggagtgtctctgcccggccgccccgtctgagagacatgtagactgccaaagtgtatgggatgctttcaagggtgcatttatttcaaaacatccttgcaacattactgaagaagactatcagccactaatgaagttgggaactcagaccgtaccttgcaacaagattcttctttggagcagaataaaagatctggcccatcagttcacacaggtccagcgggacatgttcaccctggaggacacgctgctaggctaccttgctgatgacctcacatggtgtggtgaattcaacacttccaaaataaactatcaatcttgcccagactggagaaaggactgcagcaacaaccctgtttcagtattctggaaaacggtttcccgcaggtttgcagaagctgcctgtgatgtggtccatgtgatgctcaatggatcccgcagtaaaatctttgacaaaaacagcacttttgggagtgtggaagtccataatttgcaaccagagaaggttcagacactagaggcctgggtgatacatggtggaagagaagattccagagacttatgccaggatcccaccataaaagagctggaatcgattataagcaaaaggaatattcaattttcctgcaagaatatctacagacctgacaagtttcttcagtgtgtgaaaaatcctgaggattcatcttgcacatctgagatctga

SEQ ID NO: 8178 - DNA, 483 bp, synthetic construct; identical to SEQ ID NO: 7330
  misc_feature 1..483: note = Synthetic polypeptide
  source 1..483: mol_type = other DNA

SEQ ID NO: 8179 - DNA, 742 bp, synthetic construct
  misc_feature 1..742: note = Synthetic polypeptide
  source 1..742: mol_type = other DNA
tggtgctcagctttgggcacatgtcagaatctagggaagttcttcaggatcccagcatcccagcgacatctggctggaggctttaaggagttttaagctgagtgtcactgtagaccccaaataccatcccaagattatcgggagaaagggggcagtaattacccaaatccggttggagcatgacgtgaacatccagtttcctgataaggacgatgggaaccagccccaggaccaaattaccatcacagggtacgaaaagaacacagaagctgccagggatgctatactgagaattgtgggtgaacttgagcagatggtttctgaggacgtcccgctggaccaccgcgttcacgcccgcatcattggtgcccgcggcaaagccattcgcaaaatcatggacgaattcaaggtggacattcgcttcccacagagcggagccccagaccccaactgcgtcactgtgacggggctcccagagaatgtggaggaagccatcgaccacatcctcaatctggaggaggaatacctagctgacgtggtggacagtgaggcgctgcaggtatacatgaaacccccagcacacgaagaggccaaggcaccttccagaggctttgtggtgcgggacgcaccctggaccgccagcagcagtgagaaggctcctgacatgagcagctctgaggaatttcccagctttggggctcaggtggctcccaagaccctcccttggggccccaaacgataa

SEQ ID NO: 8180 - DNA, 430 bp, synthetic construct
  misc_feature 1..430: note = Synthetic polypeptide
  source 1..430: mol_type = other DNA
tggtgctcagctttgggcacatgtcagaatctagggaagttcttcaggatcccagcatcccagcgacatctggctggaggctttaaggagttttaagctgagtgtcactgtagaccccaaataccatcccaagattatcgggagaaagggggcagtaattacccaaatccggttggagcatgacgtgaacatcctcaatctggaggaggaatacctagctgacgtggtggacagtgaggcgctgcaggtatacatgaaacccccagcacacgaagaggccaaggcaccttccagaggctttgtggtgcgggacgcaccctggaccgccagcagcagtgagaaggctcctgacatgagcagctctgaggaatttcccagctttggggctcaggtggctcccaagaccctcccttggggccccaaacgataa

SEQ ID NO: 8181 - DNA, 383 bp, synthetic construct
  misc_feature 1..383: note = Synthetic polypeptide
  source 1..383: mol_type = other DNA
taggttagtggactaatgagttatcataggagtgggactagcggctttataagaagaggaagagagacctgagctagcaggttagcatgctcagccccctggccacgtgatgccttgcaccacctcaggactctgttgaaagtacccagcagcaaagaaggttctcaccagatgcagctccttgatcttggccttctcagcctccattaactgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatag

SEQ ID NO: 8182 - DNA, 558 bp, synthetic construct
  misc_feature 1..558: note = Synthetic polypeptide
  source 1..558: mol_type = other DNA
caggttttcccatcagcatttcactgaagctgctctttctaagttataggtattctaaagaaacccatattaatccatcagaaaattcaacatcaagtttatcaacctgtttaattaatcaaaccttatcattcaatggaacatcacctgagatagtagaaaaagattgtgtaaaggaatctgggtcacacatgtggatctatgtcttcatggggaatatgcttcgtggcataggggaaacccccatagtaccattggggatttcatacattgatgattttgcaaaagaaggacattcttccttgtatttaggtagtttgaatgcaataggaatgattggtccagtcattggctttgcactgggatctctgtttgctaaaatgtacgtggatattggatatgtagatctgagcactatcagaataactcctaaggactctcgttgggttggagcttggtggcttggtttccttgtgtctggactattttccattatttcttccataccattttttttcttgccgaaaaatccaaataaaccacaaaaagaaagaaaaa

SEQ ID NO: 8183 - DNA, 1793 bp, synthetic construct
  misc_feature 1..1793: note = Synthetic polypeptide
  source 1..1793: mol_type = other DNA
caggttttcccatcagcatttcactgaagctgctctttctaagttataggtattctaaagaaacccatattaatccatcagaaaattcaacatcaagtttatcaacctgtttaattaatcaaaccttatcattcaatggaacatcacctgagatagtagaaaaagattgtgtaaaggaatctgggtcacacatgtggatctatgtcttcatggggaatatgcttcgtggcataggggaaacccccatagtaccattggggatttcatacattgatgattttgcaaaagaaggacattcttccttgtatttaggtagtttgaatgcaataggaatgattggtccagtcattggctttgcactgggatctctgtttgctaaaatgtacgtggatattggatatgtagatctgagcactatcagaataactcctaaggactctcgttgggttggagcttggtggcttggtttccttgtgtctggactattttccattatttcttccataccattttttttcttgccgaaaaatccaaataaaccacaaaaagaaagaaaaatttcactatcattgcatgtgctgaaaacaaatgatgatagaaatcaaacagctaatttgaccaaccaaggaaaaaatgttaccaaaaatgtgactggttttttccagtctttgaaaagcatccttaccaatcccctgtatgttatatttctgcttttgacattgttacaagtaagcagctttattggttcttttacttacgtctttaaatatatggagcaacagtacggtcagtctgcatctcatgctaactttttgttgggaatcataaccattcctacggttgcaactggaatgtttttaggaggatttatcattaaaaaattcaaattgtctttagttggaattgccaaattttcatttcttacttcgatgatatccttcttgtttcaacttctatatttccctctaatctgcgaaagcaaatcagttgccggcctaaccttgacctatgatggaaataattcagtggcatctcatgtagatgtaccactttcttattgcaactcagagtgcaattgtgatgaaagtcagtgggaaccagtctgtgggaacaatggaataacttacctgtcaccttgtctagcaggatgcaaatcctcaagtggtattaaaaagcatacagtgttttataactgtagttgtgtggaagtaactggtctccagaacagaaattactcagcacacttgggtgaatgcccaagagataatacttgtacaaggaaatttttcatctatgttgcaattcaagtcataaactctttgttctctgcaacaggaggtaccacatttatcttgttgactgtgaagattgttcaacctgaattgaaagcacttgcaatgggtttccagtcaatggttataagaacactaggaggaattctagctccaatatattttggggctctgattgataaaacatgtatgaagtggtccaccaacagctgtggagcacaaggggcttgtaggatatataattccgtattttttggaagggtctacttgggcttatctatagctttaagattcccagcacttgttttatatattgttttcatttttgctatgaagaaaaaatttcaaggaaaagataccaaggcatcggacaatgaaagaaaagtaatggatgaagcaaacttagaattcttaaataatggtgaacattttgtaccttctgctggaacagatagtaaaacatgtaatttggacatgcaagacaatgctgctgccaactaa

SEQ ID NO: 8184 - DNA, 1931 bp, synthetic construct
  misc_feature 1..1931: note = Synthetic polypeptide
  source 1..1931: mol_type = other DNA
caggttttcccatcagcatttcactgaagctgctctttctaagttataggtattctaaagaaacccatattaatccatcagaaaattcaacatcaagtttatcaacctgtttaattaatcaaaccttatcattcaatggaacatcacctgagatagtagaaaaagattgtgtaaaggaatctgggtcacacatgtggatctatgtcttcatggggaatatgcttcgtggcataggggaaacccccatagtaccattggggatttcatacattgatgattttgcaaaagaaggacattcttccttgtatttaggtagtttgaatgcaataggaatgattggtccagtcattggctttgcactgggatctctgtttgctaaaatgtacgtggatattggatatgtagatctgagcactatcagaataactcctaaggactctcgttgggttggagcttggtggcttggtttccttgtgtctggactattttccattatttcttccataccattttttttcttgccgaaaaatccaaataaaccacaaaaagaaagaaaaatttcactatcattgcatgtgctgaaaacaaatgatgatagaaatcaaacagctaatttgaccaaccaaggaaaaaatgttaccaaaaatgtgactggttttttccagtctttgaaaagcatccttaccaatcccctgtatgttatatttctgcttttgacattgttacaagtaagcagctttattggttcttttacttacgtctttaaatatatggagcaacagtacggtcagtctgcatctcatgctaactttttgttgggaatcataaccattcctacggttgcaactggaatgtttttaggaggatttatcattaaaaaattcaaattgtctttagttggaattgccaaattttcatttcttacttcgatgatatccttcttgtttcaacttctatatttccctctaatctgcgaaagcaaatcagttgccggcctaaccttgacctatgatggaaataattcagtggcatctcatgtagatgtaccactttcttattgcaactcagagtgcaattgtgatgaaagtcagtgggaaccagtctgtgggaacaatggaataacttacctgtcaccttgtctagcaggatgcaaatcctcaagtggtattaaaaagcatacagtgttttataactgtagttgtgtggaagtaactggtctccagaacagaaattactcagcacacttgggtgaatgcccaagagataatacttgtacaaggaaatttttcatctatgttgcaattcaagtcataaactctttgttctctgcaacaggaggtaccacatttatcttgttgactgtgaagattgttcaacctgaattgaaagcacttgcaatgggtttccagtcaatggttataagaacactaggaggaattctagctccaatatattttggggctctgattgataaaacatgtatgaagtggtccaccaacagctgtggagcacaaggggcttgtaggatatataattccgtattttttgggattgttcaacctgaattgaaagcacttgcaatcggcttccattcaatgattatgcgatcgctaggaggtattctagttccaatatattttggggctctgattgatacaacgtgtatgaagtggtccaccaacagctgtggagcacgaggggcttgtaggatatataattccacatatttgggaagagccttcttcggcttgaaggtagccctaatatttccagtacttgttttacttactgtatttatttttgttgtaaggaaaaaatcccatggaaaggataccaaagtattagaaaatgaaagacaagtaatggatgaagcaaacttagaattcttaaacgacagtgaacattttgtaccttctgctgaagaacagtaa

SEQ ID NO: 8185 - DNA, 116 bp, synthetic construct
  misc_feature 1..116: note = Synthetic polypeptide
  source 1..116: mol_type = other DNA
tttttaagaatatgaattaattgtcaaagtttaaacatggagagacttcacataatgatttggatttctggtttctttcaaaaactttggaccagagaagctctcgcatcccgtga

SEQ ID NO: 8186 - DNA, 105 bp, synthetic construct
  misc_feature 1..105: note = Synthetic polypeptide
  source 1..105: mol_type = other DNA
tttttaagaatatgaattaattgtcaaagtttaaacatggagagacttcacataatgatttggatttctggtttctttcaaaaactttggaccagagaagctctc

SEQ ID NO: 8187 - DNA, 738 bp, synthetic construct
  misc_feature 1..738: note = Synthetic polypeptide
  source 1..738: mol_type = other DNA
tgttcagtagcacaatagggtgaccgtagttaataatttgttgtgtttcaaatagccagaagagaagatttggaatatcccagcacaaaggaatgagccgtgtttgaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagttgaaggagaagagccaggcgtgcggagggaacttggggtccattgaagagctgcgaggggccatctacctagcggaggaggcgtgccctggcatctccgacaccatggtggcccagctcgtgcagcggctccagagatactctctaagtggtggaggaacttcatcccactga

SEQ ID NO: 8188 - DNA, 807 bp, synthetic construct
  misc_feature 1..807: note = Synthetic polypeptide
  source 1..807: mol_type = other DNA
tgttcagtagcacaatagggtgaccgtagttaataatttgttgtgtttcaaatagccagaagagaagatttggaatatcccagcacaaaggaatgagccgtgtttgaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccgaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagagatactctctaagtggtggaggaacttcatcccactga

SEQ ID NO: 8189 - DNA, 867 bp, synthetic construct
  misc_feature 1..867: note = Synthetic polypeptide
  source 1..867: mol_type = other DNA
tgttcagtagcacaatagggtgaccgtagttaataatttgttgtgtttcaaatagccagaagagaagatttggaatatcccagcacaaaggaatgagccgtgtttgaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccgaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagaggagtatccatgggaaccaagcccctcctgactgccatctggcacaagtgcaggcgtttggaggcagtggatgtgtgctgggaagccgctctgtgtga

SEQ ID NO: 8190 - DNA, 2578 bp, synthetic construct; identical to SEQ ID NO: 7194
  misc_feature 1..2578: note = Synthetic polypeptide
  source 1..2578: mol_type = other DNA

SEQ ID NO: 8191 - DNA, 2305 bp, synthetic construct; identical to SEQ ID NO: 7195
  misc_feature 1..2305: note = Synthetic polypeptide
  source 1..2305: mol_type = other DNA

SEQ ID NO: 8192 - DNA, 1759 bp, synthetic construct; identical to SEQ ID NO: 7196
  misc_feature 1..1759: note = Synthetic polypeptide
  source 1..1759: mol_type = other DNA

SEQ ID NO: 8193 - DNA, 340 bp, synthetic construct
  misc_feature 1..340: note = Synthetic polypeptide
  source 1..340: mol_type = other DNA
cagctctggtgtgactgtcaacgccctgcaccccggcgtggccaggacagagctgggcagacacacgggcatccatggctccaccttctccagcaccacactcgggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataa

SEQ ID NO: 8194 - DNA, 1019 bp, synthetic construct
  misc_feature 1..1019: note = Synthetic polypeptide
  source 1..1019: mol_type = other DNA
gtctacttgcttttctaattgtgggtcctaagaccctcatttcaaaaggggtcccatcacataccctggaggaaggaatgttgcacggaggacggtaagaagccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtag

SEQ ID NO: 8195 - DNA, 962 bp, synthetic construct
  misc_feature 1..962: note = Synthetic polypeptide
  source 1..962: mol_type = other DNA
gtctacttgcttttctaattgtgggtcctaagaccctcatttcaaaaggggtcccatcacataccctggaggaaggaatgttgcacggaggacggtaagaagccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaagcccaagccagtgacctggaaaaaatccacctggatgagaagtctttccgttggttgcacaacgaggaccagatggctgtggagaagctctctgacgggatccgcaagtttgccgctgatgcagtga

SEQ ID NO: 8196 - DNA, 287 bp, synthetic construct
  misc_feature 1..287: note = Synthetic polypeptide
  source 1..287: mol_type = other DNA
gtctacttgcttttctaattgtgggtcctaagaccctcatttcaaaaggggtcccatcacataccctggaggaaggaatgttgcacggaggacggtaagaagccatcgacgagtacaagccccaggatgctaccaccaacccgtccctgatcctggccgcagcacagatgcccgcttaccaggagctggtggaggaggcgattgcctatggccggaagctgggcggaaatactaaagaagattccgggccgagtatccacagaagtagacgcaaggctctcctttga

SEQ ID NO: 8197 - DNA, 186 bp, synthetic construct; identical to SEQ ID NO: 7638
  misc_feature 1..186: note = Synthetic polypeptide
  source 1..186: mol_type = other DNA

SEQ ID NO: 8198 - DNA, 366 bp, synthetic construct; identical to SEQ ID NO: 7663
  misc_feature 1..366: note = Synthetic polypeptide
  source 1..366: mol_type = other DNA

SEQ ID NO: 8199 - DNA, 3401 bp, synthetic construct
  misc_feature 1..3401: note = Synthetic polypeptide
  source 1..3401: mol_type = other DNA
ccttgctactcaaagtgtggtccacgggccagcagcatcagccacacctgggagtgtgttataaaagcaggatcccagccctagctcagatctgctgagtcagaagctgcagttcaacaagcttcctaggagacctgaagactgtgtccacaaagggcaagaccaccactgcagatatccacagctacggcagcagtggtggtggtggcagtggaggaggtggcggtgttggtggcgctggcggcggcccttggggaccagcgccagcctggtgcccctgcggctcctgctgcagctggtggaagtggctgctgggcctgctgctcacctggctgctactcctggggctgctcttcggcctcattgctctggcggaggaggtgaggaagctgaaggcgcgtgtggatgagctggagaggatcaggaggagcatactgccctatggggacagcatggatagaatagaaaaggaccgcctccagggcatggcacccgcggcgggagcagacctggacaaaattgggctgcacagtgacagccaggaggagctctggatgttcgtgaggaagaagctaatgatggaacaggaaaatggaaatctccgaggaagccctggccctaaaggtgacatgggaagtccaggccctaaaggagatcgagggttccctgggactccaggtatccctgggcccttgggccacccaggtccacaaggaccaaagggtcaaaaaggcagcgtgggagatcctggcatggaaggccccatgggccagagagggcgagaaggccccatgggacctcgtggtgaggcagggcctcctggatctggagagaaaggggaaagaggggctgctggtgaaccaggtcctcatggcccacctggtgtcccaggttctgtgggtcccaaaggttccagcggctctcctggcccacagggccctccaggtcctgtaggtctccaagggctccgaggtgaagtaggacttcctggtgtcaaaggtgacaaaggaccaatgggaccaccaggacccaaaggtgaccagggtgagaaaggacctcgaggcctcacaggcgagcctggcatgagaggtttgcctggtgctgttggtgagcccggggctaaaggagcaatgggtcctgctggcccagacggacaccaaggcccaagaggtgaacaaggtcttactgggatgcctggaatccgtggcccaccaggaccttctggagacccaggaaagccaggtctcacaggaccccagggacctcagggacttcccggtacccctggccgaccaggaataaaaggtgaaccaggagctccaggcaagatcgtgacttcggaggggtcatcgatgctcactgtcccaggccccccaggacctcctggagccatgggacccccaggacctccaggtgccccaggccctgccggcccagctggtctcccaggacatcaagaagttcttaatttacaaggtcccccaggcccacccggcccacgcgggccaccagggccttccattccaggcccaccaggaccccgaggcccaccaggggagggtttgccaggcccaccaggcccaccaggatcgttcctgtccaactcagaaaccttcctctccggccccccaggcccacctggccccccaggtcccaagggagaccaaggtcccccaggccccagaggacaccaaggcgagcaaggcctcccaggtttctcaacctcagggtccagttctttcggactcaaccttcagggaccaccaggcccacctggcccccagggacccaaaggtgacaaaggtgatccaggtgttccaggggctcttggcattcctagtggtccttctgaagggggatcatcaagtaccatgtacgtgtcaggcccgccagggccccctgggccccctgggcctccgggctctatcagcagctctggccaggagattcagcagtacatctctgagtacatgcagagtgacagtattagatcttacctatccggagttcagggtcccccaggcccacctggtcccccaggacctgtcaccaccatcacaggcgagactttcgactactcagagctggcaagccacgttgtgagctacttacggacttcggggtacggtgtcagcttgttctcgtcctccatctcttctgaagacattctggctgtgctgcagcgggatgacgtgcgtcagtacctacgtcagtacttgatgggccctcggggtccgccagggccaccaggagccagtggagatgggtccctcctgtctttggactatgcagagctgagtagtcgcattctcagctacatgtcgagttctgggatcagcattgggcttcctggtcccccggggccccctggcttgccgggaacctcctatgaggagctcctctccttgctgcgagggtctgaattcagaggcatcgttggacccccaggtcccccgggtccaccagggatcccaggcaatgtgtggtccagcatcagcgtggaggacctctcgtcttacttacatactgccggcttgtcattcatcccaggccctccaggacctcctggtcccccagggcctcgagggcccccgggtgtctcaggagccctggcaacctatgcagctgaaaacagcgacagcttccggagcgagctgatcagctacctcacaagtcctgatgtgcgcagcttcattgttggccccccaggccctcctgggccgcagggaccccctggggacagccgcctcctgtccacggatgcctcccacagtcggggtagcagctcctcctcacacagctcatctgtcaggcggggcagctcctacagctcttccatgagcacaggaggaggtggtgcaggctccctgggtgcaggcggtgcctttggtgaagctgcaggagacaggggtccctatggcactgacatcggcccaggcggaggctatggggcagcagcagaaggcggcatgtatgctggcaatggcggactattgggagctgactttgctggagatctggattacaatgagctggctgtgagggtgtcagagagcatgcagcgtcagggcctactgcaagggatggcctacactgtccagggcccaccaggccagcctgggccacaggggccacccggcatcagcaaggtcttctctgcctacagcaacgtgactgcggacctcatggacttcttccaaacttatggagccattcaaggaccccctgggcaaaaaggagagatgggcactccaggacccaaaggtgacaggggccctgctgggccaccaggtcatcctgggccacctggccctcgaggacacaagggagaaaaaggagacaaaggtgaccaagtctatgctgggcggagaaggagaagaagtattgctgtcaagccgtga

SEQ ID NO: 8200 - DNA, 3155 bp, synthetic construct
  misc_feature 1..3155: note = Synthetic polypeptide
  source 1..3155: mol_type = other DNA
ccttgctactcaaagtgtggtccacgggccagcagcatcagccacacctgggagtgtgttataaaagcaggatcccagccctagctcagatctgctgagtcagaagctgcagttcaacaagcttcctaggagacctgaagactgtgtccacaaagggcaagaccaccactgcagatatccacagctacggcagcagtggtggtggtggcagtggaggaggtggcggtgttggtggcgctggcggcggcccttggggaccagcgccagcctggtgcccctgcggctcctgctgcagctggtggaagtggctgctgggcctgctgctcacctggctgctactcctggggctgctcttcggcctcattgctctggcggaggaggtgaggaagctgaaggcgcgtgtggatgagctggagaggatcaggaggagcatactgccctatggggacagcatggatagaatagaaaaggaccgcctccagggcatggcacccgcggcgggagcagacctggacaaaattgggctgcacagtgacagccaggaggagctctggatgttcgtgaggaagaagctaatgatggaacaggaaaatggaaatctccgaggaagccctggccctaaaggtgacatgggaagtccaggccctaaaggagatcgagggttccctgggactccaggtatccctgggcccttgggccacccaggtccacaaggaccaaagggtcaaaaaggcagcgtgggagatcctggcatggaaggccccatgggccagagagggcgagaaggccccatgggacctcgtggtgaggcagggcctcctggatctggagagaaaggggaaagaggggctgctggtgaaccaggtcctcatggcccacctggtgtcccaggttctgtgggtcccaaaggttccagcggctctcctggcccacagggccctccaggtcctgtaggtctccaagggctccgaggtgaagtaggacttcctggtgtcaaaggtgacaaaggaccaatgggaccaccaggacccaaaggtgaccagggtgagaaaggacctcgaggcctcacaggcgagcctggcatgagaggtttgcctggtgctgttggtgagcccggggctaaaggagcaatgggtcctgctggcccagacggacaccaaggcccaagaggtgaacaaggtcttactgggatgcctggaatccgtggcccaccaggaccttctggagacccaggaaagccaggtctcacaggaccccagggacctcagggacttcccggtacccctggccgaccaggaataaaaggtgaaccaggagctccaggcaagatcgtgacttcggaggggtcatcgatgctcactgtcccaggccccccaggacctcctggagccatgggacccccaggacctccaggtgccccaggccctgccggcccagctggtctcccaggacatcaagaagttcttaatttacaaggtcccccaggcccacccggcccacgcgggccaccagggccttccattccaggcccaccaggaccccgaggcccaccaggggagggtttgccaggcccaccaggcccaccaggatcgttcctgtccaactcagaaaccttcctctccggccccccaggcccacctggccccccaggtcccaagggagaccaaggtgatccaggtgttccaggggctcttggcattcctagtggtccttctgaagggggatcatcaagtaccatgtacgtgtcaggcccgccagggccccctgggccccctgggcctccgggctctatcagcagctctggccaggagattcagcagtacatctctgagtacatgcagagtgacagtattagatcttacctatccggagttcagggtcccccaggcccacctggtcccccaggacctgtcaccaccatcacaggcgagactttcgactactcagagctggcaagccacgttgtgagctacttacggacttcggggtacggtgtcagcttgttctcgtcctccatctcttctgaagacattctggctgtgctgcagcgggatgacgtgcgtcagtacctacgtcagtacttgatgggccctcggggtccgccagggccaccaggagccagtggagatgggtccctcctgtctttggactatgcagagctgagtagtcgcattctcagctacatgtcgagttctgggatcagcattgggcttcctggtcccccggggccccctggcttgccgggaacctcctatgaggagctcctctccttgctgcgagctgccggcttgtcattcatcccaggccctccaggacctcctggtcccccagggcctcgagggcccccgggtgtctcaggagccctggcaacctatgcagctgaaaacagcgacagcttccggagcgagctgatcagctacctcacaagtcctgatgtgcgcagcttcattgttggccccccaggccctcctgggccgcagggaccccctggggacagccgcctcctgtccacggatgcctcccacagtcggggtagcagctcctcctcacacagctcatctgtcaggcggggcagctcctacagctcttccatgagcacaggaggaggtggtgcaggctccctgggtgcaggcggtgcctttggtgaagctgcaggagacaggggtccctatggcactgacatcggcccaggcggaggctatggggcagcagcagaaggcggcatgtatgctggcaatggcggactattgggagctgactttgctggagatctggattacaatgagctggctgtgagggtgtcagagagcatgcagcgtcagggcctactgcaagggatggcctacactgtccagggcccaccaggccagcctgggccacaggggccacccggcatcagcaaggtcttctctgcctacagcaacgtgactgcggacctcatggacttcttccaaacttatggagccattcaaggaccccctgggcaaaaaggagagatgggcactccaggacccaaaggtgacaggggccctgctgggccaccaggtcatcctgggccacctggccctcgaggacacaagggagaaaaaggagacaaaggtgaccaagtctatgctgggcggagaaggagaagaagtattgctgtcaagccgtga

SEQ ID NO: 8201 - DNA, 4686 bp, synthetic construct
  misc_feature 1..4686: note = Synthetic polypeptide
  source 1..4686: mol_type = other DNA
gttgaagaaaggaaaccttttgatcatctcattagatgccaagaaggttacaccggatgacatcaattgaaagagaagaaaaggagaaagtcaaaaaaaaagagaagaaacaggaagaagaagaaacgatgcagcaagcgacatgggtaaaatacacatttccagttaagcatcaggtttggaaacaaaaaggtgaagagtacagagtgacaggatatggtggttggagctggattagtaaaactcatgtttataggtttgttcctaaattgccaggcaatactaatgtgaattacagaaagtcgttagaaggaaccaaaaataatatggatgaaaatatggatgagtcagataaaagaaaatgttcacgaagtccaaaaaaaataaaaatagagcctgattctgaaaaagatgaggtaaaaggttcagatgctgcaaaaggagcagaccaaaatgaaatggatatctcaaagattactgagaagaaggaccaagatgtgaaggagctcttagattctgacagtgataaaccctgcaaggaagaaccaatggaagtagacgatgacatgaaaacagagtcacatgtaaattgtcaggagagttctcaagtagatgtggtcaatgttagtgagggttttcatctaaggactagttacaaaaagaaaacaaaatcatccaaactagatggacttcttgaaaggagaattaaacagtttacactggaagaaaaacagcgactcgaaaaaatcaagttggagggtggaattaagggtataggaaagacttctacaaattcttcaaaaaatctctctgaatcaccagtaataacgaaagcaaaagaagggtgtcagagtgactcgatgagacaagaacagagcccaaatgcaaataatgatcaacctgaggacttgattcagggatgttcagaaagtgattcctcagttcttagaatgagtgatcctagtcataccacaaacaaactttatccaaaagatcgagtgttagatgatgtctccattcggagcccagaaacaaaatgtccgaaacaaaattccattgaaaatgacatagaagaaaaagtctctgaccttgccagtagaggccaggaacccagtaagagtaaaacaaaaggaaatgattttttcatcgatgactctaaactagccagtgcagatgatattggtactttgatctgtaagaacaaaaaaccgctcatacaggaggaaagtgacaccattgtttcttcttccaagagtgctttacattcatcagtgcctaaaagtaccaatgacagagatgccacacctctgtcaagagcaatggactttgaaggaaaactgggatgtgactctgaatctaatagcactttggaaaatagttctgataccgtgtctattcaggatagcagtgaagaagatatgattgttcagaatagcaatgaaagcatttctgaacagttcagaactcgagaacaagatgttgaagtcttggagccgttaaagtgtgagttggtttctggtgagtccactggaaactgtgaggacaggctgccggtcaaggggactgaagcaaatggtaaaaaaccaagtcagcagaagaaattagaggagagaccagttaataaatgtagtgatcaaataaagctaaaaaataccactgacaaaaagaataatgaaaatcgagagtctgaaaagaaaggacagagaacaagtacatttcaaataaatggaaaagataataaacccaaaatatatttgaaaggtgaatgcttgaaagaaatttctgagagtagagtagtaagtggtaatgttgaaccaaaggttaataatataaataaaataatccctgagaatgatattaaatcattgactgttaaagaatctgctataaggccattcattaatggtgatgtcatcatggaagattttaatgaaagaaacagctccgaaacaaaatcgcatttgctgagttcttcagatgctgaaggtaactaccgagatagccttgagaccctgccatcaaccaaagagtctgacagtacacagacgaccacaccctcagcatcttgtccagaaagcaattcagttaatcaggtagaagatatggaaatagaaacctcagaagttaagaaagttacttcatcacctattacttctgaagaggaatctaatctcagtaatgactttattgatgaaaatggtctgcccatcaacaaaaatgaaaatgtcaatggagaatctaaaagaaaaaccgtcatcacagaagtcaccacgatgacctccacagtggccacagaatcaaaaactgtgatcaaggtagaaaaaggcgataagcaaactgtggtttcttccacagaaaattgtgcaaaatccactgtcacaaccaccactacaacagtgaccaagctttccacaccctccacaggcggcagtgtggacatcatctctgtaaaggagcagagcaaaaccgtggtcaccacgacagtgacagactccctgaccaccacgggaggcacactggttacatctatgactgtgagcaaagagtattccacacgagacaaagtgaaactgatgaaattttcaagaccaaagaagactcgttcaggtacagctctgccatcctatagaaaatttgttaccaagagcagcaagaagagcatttttgttttgcctaatgatgacttaaaaaagttggcccgaaaaggaggaatccgagaggtcccttattttaattacaatgcaaaacctgctttggatatatggccatatccttctcctagaccgacctttggcatcacttggaggtatagacttcagacagtaaagtccttagctggagtgagcctgatgttacggttactgtgggcaagtttgagatgggatgatatggcggccaaggctcctccaggaggagggactacacggacagaaacatccgaaactgaaatcacaacaacagaaataattaagaggagagatgttggtccttatggcattcgatctgaatattgtatcaggaaaatcatttgtcccattggagttccagaaacaccaaaagaaacgcctacacctcagaggaaaggccttcgatcaagtgcactgcggccaaagagaccagaaacgcccaagcaaactggccctgttattattgaaacctgggtagcagaagaagaactggaattgtgggagatcagggcatttgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcaggcgttgttcaagtacagcagaaagtcctgggtatcattccatcaagtacaggtaccagtcagcaaacctttacttcattccagcccaggacagcaacagtcacaattaggcccaatacctcaggctctggaggaaccacaagcaattcacaagtaatcacagggcctcagattcgccctggtatgaccgtgattagaacaccactccaacagtcaacactaggaaaggcaattattcgaacacctgtgatggtacagccaggtgctcctcagcaagtgatgactcaaatcatcagggggcagcctgtctccactgcagtctccgcccctaacacggtttcctcaacacctgggcagaaaagcttaacttcagcaacgtccacttcaaatatacagtcttcagcctcacaaccccctcgcccccaacaaggacaagtgaagctcaccatggctcaacttactcagttaacacagggccacggtggcaatcaaggtttgacagtagtaattcaaggacaaggtcaaactactggacagttgcagttgatacctcaaggggtgactgtactcccaggcccaggccagcagctaatgcaagctgcaatgccaaatggtactgttcagcgattcctctttaccccattggcaacaacagccaccacagccagcaccaccaccaccactgtttccacgacagcagcaggtacaggtgaacaaaggcagagtaaactgtcaccccagatgcaggtacatcaagacaaaaccctgccaccagctcagtcatcaagtgtgggtccagcagaagcccagccacagactgctcagccttcagctcagccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcacagtctcagcctcaaagtaatgtccaaggacagtctcctgttcgtgtccaaagtccatcacagactcgaatacgtccatcaactccatcccaactgtctcctggacaacaatcccaggttcagactacaacctcacaaccgattccaattcaaccacatacatctcttcagataccttcccaaggccagccacagtcacaac

SEQ ID NO: 8202 - DNA, 6266 bp, synthetic construct
  misc_feature 1..6266: note = Synthetic polypeptide
  source 1..6266: mol_type = other DNA
gttgaagaaaggaaaccttttgatcatctcattagatgccaagaaggttacaccggatgacatcaattgaaagagaagaaaaggagaaagtcaaaaaaaaagagaagaaacaggaagaagaagaaacgatgcagcaagcgacatgggtaaaatacacatttccagttaagcatcaggtttggaaacaaaaaggtgaagagtacagagtgacaggatatggtggttggagctggattagtaaaactcatgtttataggtttgttcctaaattgccaggcaatactaatgtgaattacagaaagtcgttagaaggaaccaaaaataatatggatgaaaatatggatgagtcagataaaagaaaatgttcacgaagtccaaaaaaaataaaaatagagcctgattctgaaaaagatgaggtaaaaggttcagatgctgcaaaaggagcagaccaaaatgaaatggatatctcaaagattactgagaagaaggaccaagatgtgaaggagctcttagattctgacagtgataaaccctgcaaggaagaaccaatggaagtagacgatgacatgaaaacagagtcacatgtaaattgtcaggagagttctcaagtagatgtggtcaatgttagtgagggttttcatctaaggactagttacaaaaagaaaacaaaatcatccaaactagatggacttcttgaaaggagaattaaacagtttacactggaagaaaaacagcgactcgaaaaaatcaagttggagggtggaattaagggtataggaaagacttctacaaattcttcaaaaaatctctctgaatcaccagtaataacgaaagcaaaagaagggtgtcagagtgactcgatgagacaagaacagagcccaaatgcaaataatgatcaacctgaggacttgattcagggatgttcagaaagtgattcctcagttcttagaatgagtgatcctagtcataccacaaacaaactttatccaaaagatcgagtgttagatgatgtctccattcggagcccagaaacaaaatgtccgaaacaaaattccattgaaaatgacatagaagaaaaagtctctgaccttgccagtagaggccaggaacccagtaagagtaaaacaaaaggaaatgattttttcatcgatgactctaaactagccagtgcagatgatattggtactttgatctgtaagaacaaaaaaccgctcatacaggaggaaagtgacaccattgtttcttcttccaagagtgctttacattcatcagtgcctaaaagtaccaatgacagagatgccacacctctgtcaagagcaatggactttgaaggaaaactgggatgtgactctgaatctaatagcactttggaaaatagttctgataccgtgtctattcaggatagcagtgaagaagatatgattgttcagaatagcaatgaaagcatttctgaacagttcagaactcgagaacaagatgttgaagtcttggagccgttaaagtgtgagttggtttctggtgagtccactggaaactgtgaggacaggctgccggtcaaggggactgaagcaaatggtaaaaaaccaagtcagcagaagaaattagaggagagaccagttaataaatgtagtgatcaaataaagctaaaaaataccactgacaaaaagaataatgaaaatcgagagtctgaaaagaaaggacagagaacaagtacatttcaaataaatggaaaagataataaacccaaaatatatttgaaaggtgaatgcttgaaagaaatttctgagagtagagtagtaagtggtaatgttgaaccaaaggttaataatataaataaaataatccctgagaatgatattaaatcattgactgttaaagaatctgctataaggccattcattaatggtgatgtcatcatggaagattttaatgaaagaaacagctccgaaacaaaatcgcatttgctgagttcttcagatgctgaaggtaactaccgagatagccttgagaccctgccatcaaccaaagagtctgacagtacacagacgaccacaccctcagcatcttgtccagaaagcaattcagttaatcaggtagaagatatggaaatagaaacctcagaagttaagaaagttacttcatcacctattacttctgaagaggaatctaatctcagtaatgactttattgatgaaaatggtctgcccatcaacaaaaatgaaaatgtcaatggagaatctaaaagaaaaaccgtcatcacagaagtcaccacgatgacctccacagtggccacagaatcaaaaactgtgatcaaggtagaaaaaggcgataagcaaactgtggtttcttccacagaaaattgtgcaaaatccactgtcacaaccaccactacaacagtgaccaagctttccacaccctccacaggcggcagtgtggacatcatctctgtaaaggagcagagcaaaaccgtggtcaccacgacagtgacagactccctgaccaccacgggaggcacactggttacatctatgactgtgagcaaagagtattccacacgagacaaagtgaaactgatgaaattttcaagaccaaagaagactcgttcaggtacagctctgccatcctatagaaaatttgttaccaagagcagcaagaagagcatttttgttttgcctaatgatgacttaaaaaagttggcccgaaaaggaggaatccgagaggtcccttattttaattacaatgcaaaacctgctttggatatatggccatatccttctcctagaccgacctttggcatcacttggaggtatagacttcagacagtaaagtccttagctggagtgagcctgatgttacggttactgtgggcaagtttgagatgggatgatatggcggccaaggctcctccaggaggagggactacacggacagaaacatccgaaactgaaatcacaacaacagaaataattaagaggagagatgttggtccttatggcattcgatctgaatattgtatcaggaaaatcatttgtcccattggagttccagaaacaccaaaagaaacgcctacacctcagaggaaaggccttcgatcaagtgcactgcggccaaagagaccagaaacgcccaagcaaactggccctgttattattgaaacctgggtagcagaagaagaactggaattgtgggagatcagggcatttgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcaggcgttgttcaagtacagcagaaagtcctgggtatcattccatcaagtacaggtaccagtcagcaaacctttacttcattccagcccaggacagcaacagtcacaattaggcccaatacctcaggctctggaggaaccacaagcaattcacaagtaatcacagggcctcagattcgccctggtatgaccgtgattagaacaccactccaacagtcaacactaggaaaggcaattattcgaacacctgtgatggtacagccaggtgctcctcagcaagtgatgactcaaatcatcagggggcagcctgtctccactgcagtctccgcccctaacacggtttcctcaacacctgggcagaaaagcttaacttcagcaacgtccacttcaaatatacagtcttcagcctcacaaccccctcgcccccaacaaggacaagtgaagctcaccatggctcaacttactcagttaacacagggccacggtggcaatcaaggtttgacagtagtaattcaaggacaaggtcaaactactggacagttgcagttgatacctcaaggggtgactgtactcccaggcccaggccagcagctaatgcaagctgcaatgccaaatggtactgttcagcgattcctctttaccccattggcaacaacagccaccacagccagcaccaccaccaccactgtttccacgacagcagcaggtacaggtgaacaaaggcagagtaaactgtcaccccagatgcaggtacatcaagacaaaaccctgccaccagctcagtcatcaagtgtgggtccagcagaagcccagccacagactgctcagccttcagctcagccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcacagtctcagcctcaaagtaatgtccaaggacagtctcctgttcgtgtccaaagtccatcacagactcgaatacgtccatcaactccatcccaactgtctcctggacaacaatcccaggttcagactacaacctcacaaccgattccaattcaaccacatacatctcttcagataccttcccaaggccagccacagtcacaaccccaggtacagtcttcaactcaaactctttcatcaggacaaactttaaatcaagttactgtttcatccccatcccgtcctcagctacaaatacagcagccacagccccaagtcattgctgtgcctcagctgcaacaacaagtccaggttctctctcagatccagtcacaggttgtggctcagatacaggctcagcaaagtggtgtgccccagcaaatcaaactccagttacctatccaaattcagcaaagcagtgctgtgcagactcaccagattcagaatgtggttacagtgcaggcagccagtgtgcaagagcagttgcaaagggttcagcaactcagggatcagcagcaaaagaagaaacagcaacagatagaaattaagcgtgaacacaccctccaagcttctaatcaaagtgaaatcattcagaaacaggtggtgatgaagcataatgctgtaatagaacatttaaaacagaaaaagagcatgactccagctgaaagagaagagaatcaaagaatgattgtctgtaaccaggtgatgaagtatattttggataagatagataaagaagaaaaacaggcagcaaaaaaacggaagcgtgaagagagtgtggagcagaaacgtagcaagcagaatgccactaagctgtcagctctgctcttcaagcacaaagagcagctcagagccgagatcctgaagaagagagcactcctggacaaggatctgcaaattgaagtgcaggaagagctgaagagagacctgaaaattaagaaagaaaaagacctgatgcagttggctcaggccacagcagtagctgcaccctgccccccagtgacaccagctcctccagcccctccagcccctccaccttcacctccccctccacctgctgtgcaacacacaggccttctgtccacgcccaccttacctgctgcttcccagaagaggaagcgggaagaggaaaaagactccagctcaaagtccaagaaaaagaaaatgatctctactacctcaaaggaaactaagaaggacacaaagctttactgtatctgtaaaacgccttatgatgaatctaaattttatattggctgtgatcggtgtcagaattggtaccatgggcgctgcgttggcatcttgcaaagtgaggcagagctcattgatgagtatgtctgtccacagtgccagtcaacagaggatgccatgacagtgctcacgccactaacagagaaggattatgaggggttgaagagggtgctccgttccttacaggcccataagatggcctggcctttccttgaaccagtagaccctaatgatgcaccagattattatggtgttattaaggaacctatggaccttgccaccatggaagaaagagtacaaagacgatattatgaaaagctgacggaatttgtggcagatatgaccaaaatttttgataactgtcgttactacaatccaagtgactccccattttaccagtgtgcagaagttctcgaatcattctttgtacagaaattgaaaggcttcaaagctagcaggtctcataacaacaaactgcagtctacagcttcttaa

SEQ ID NO: 8203 - DNA, 5837 bp, synthetic construct
  misc_feature 1..5837: note = Synthetic polypeptide
  source 1..5837: mol_type = other DNA
gttgaagaaaggaaaccttttgatcatctcattagatgccaagaaggttacaccggatgacatcaattgaaagagaagaaaaggagaaagtcaaaaaaaaagagaagaaacaggaagaagaagaaacgatgcagcaagcgacatgggtaaaatacacatttccagttaagcatcaggtttggaaacaaaaaggtgaagagtacagagtgacaggatatggtggttggagctggattagtaaaactcatgtttataggtttgttcctaaattgccaggcaatactaatgtgaattacagaaagtcgttagaaggaaccaaaaataatatggatgaaaatatggatgagtcagataaaagaaaatgttcacgaagtccaaaaaaaataaaaatagagcctgattctgaaaaagatgaggtaaaaggttcagatgctgcaaaaggagcagaccaaaatgaaatggatatctcaaagattactgagaagaaggaccaagatgtgaaggagctcttagattctgacagtgataaaccctgcaaggaagaaccaatggaagtagacgatgacatgaaaacagagtcacatgtaaattgtcaggagagttctcaagtagatgtggtcaatgttagtgagggttttcatctaaggactagttacaaaaagaaaacaaaatcatccaaactagatggacttcttgaaaggagaattaaacagtttacactggaagaaaaacagcgactcgaaaaaatcaagttggagggtggaattaagggtataggaaagacttctacaaattcttcaaaaaatctctctgaatcaccagtaataacgaaagcaaaagaagggtgtcagagtgactcgatgagacaagaacagagcccaaatgcaaataatgatcaacctgaggacttgattcagggatgttcagaaagtgattcctcagttcttagaatgagtgatcctagtcataccacaaacaaactttatccaaaagatcgagtgttagatgatgtctccattcggagcccagaaacaaaatgtccgaaacaaaattccattgaaaatgacatagaagaaaaagtctctgaccttgccagtagaggccaggaacccagtaagagtaaaacaaaaggaaatgattttttcatcgatgactctaaactagccagtgcagatgatattggtactttgatctgtaagaacaaaaaaccgctcatacaggaggaaagtgacaccattgtttcttcttccaagagtgctttacattcatcagtgcctaaaagtaccaatgacagagatgccacacctctgtcaagagcaatggactttgaaggaaaactgggatgtgactctgaatctaatagcactttggaaaatagttctgataccgtgtctattcaggatagcagtgaagaagatatgattgttcagaatagcaatgaaagcatttctgaacagttcagaactcgagaacaagatgttgaagtcttggagccgttaaagtgtgagttggtttctggtgagtccactggaaactgtgaggacaggctgccggtcaaggggactgaagcaaatggtaaaaaaccaagtcagcagaagaaattagaggagagaccagttaataaatgtagtgatcaaataaagctaaaaaataccactgacaaaaagaataatgaaaatcgagagtctgaaaagaaaggacagagaacaagtacatttcaaataaatggaaaagataataaacccaaaatatatttgaaaggtgaatgcttgaaagaaatttctgagagtagagtagtaagtggtaatgttgaaccaaaggttaataatataaataaaataatccctgagaatgatattaaatcattgactgttaaagaatctgctataaggccattcattaatggtgatgtcatcatggaagattttaatgaaagaaacagctccgaaacaaaatcgcatttgctgagttcttcagatgctgaaggtaactaccgagatagccttgagaccctgccatcaaccaaagagtctgacagtacacagacgaccacaccctcagcatcttgtccagaaagcaattcagttaatcaggtagaagatatggaaatagaaacctcagaagttaagaaagttacttcatcacctattacttctgaagaggaatctaatctcagtaatgactttattgatgaaaatggtctgcccatcaacaaaaatgaaaatgtcaatggagaatctaaaagaaaaaccgtcatcacagaagtcaccacgatgacctccacagtggccacagaatcaaaaactgtgatcaaggtagaaaaaggcgataagcaaactgtggtttcttccacagaaaattgtgcaaaatccactgtcacaaccaccactacaacagtgaccaagctttccacaccctccacaggcggcagtgtggacatcatctctgtaaaggagcagagcaaaaccgtggtcaccacgacagtgacagactccctgaccaccacgggaggcacactggttacatctatgactgtgagcaaagagtattccacacgagacaaagtgaaactgatgaaattttcaagaccaaagaagactcgttcaggtacagctctgccatcctatagaaaatttgttaccaagagcagcaagaagagcatttttgttttgcctaatgatgacttaaaaaagttggcccgaaaaggaggaatccgagaggtcccttattttaattacaatgcaaaacctgctttggatatatggccatatccttctcctagaccgacctttggcatcacttggaggtatagacttcagacagtaaagtccttagctggagtgagcctgatgttacggttactgtgggcaagtttgagatgggatgatatggcggccaaggctcctccaggaggagggactacacggacagaaacatccgaaactgaaatcacaacaacagaaataattaagaggagagatgttggtccttatggcattcgatctgaatattgtatcaggaaaatcatttgtcccattggagttccagaaacaccaaaagaaacgcctacacctcagaggaaaggccttcgatcaagtgcactgcggccaaagagaccagaaacgcccaagcaaactggccctgttattattgaaacctgggtagcagaagaagaactggaattgtgggagatcagggcatttgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcaggcgttgttcaagtacagcagaaagtcctgggtatcattccatcaagtacaggtaccagtcagcaaacctttacttcattccagcccaggacagcaacagtcacaattaggcccaatacctcaggctctggaggaaccacaagcaattcacaagtaatcacagggcctcagattcgccctggtatgaccgtgattagaacaccactccaacagtcaacactaggaaaggcaattattcgaacacctgtgatggtacagccaggtgctcctcagcaagtgatgactcaaatcatcagggggcagcctgtctccactgcagtctccgcccctaacacggtttcctcaacacctgggcagaaaagcttaacttcagcaacgtccacttcaaatatacagtcttcagcctcacaaccccctcgcccccaacaaggacaagtgaagctcaccatggctcaacttactcagttaacacagggccacggtggcaatcaaggtttgacagtagtaattcaaggacaaggtcaaactactggacagttgcagttgatacctcaaggggtgactgtactcccaggcccaggccagcagctaatgcaagctgcaatgccaaatggtactgttcagcgattcctctttaccccattggcaacaacagccaccacagccagcaccaccaccaccactgtttccacgacagcagcaggtacaggtgaacaaaggcagagtaaactgtcaccccagatgcaggtacatcaagacaaaaccctgccaccagctcagtcatcaagtgtgggtccagcagaagcccagccacagactgctcagccttcagctcagccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcacagtctcagcctcaaagtaatgtccaaggacagtctcctgttcgtgtccaaagtccatcacagactcgaatacgtccatcaactccatcccaactgtctcctggacaacaatcccaggttcagactacaacctcacaaccgattccaattcaaccacatacatctcttcagataccttcccaaggccagccacagtcacaaccccaggtggtgatgaagcataatgctgtaatagaacatttaaaacagaaaaagagcatgactccagctgaaagagaagagaatcaaagaatgattgtctgtaaccaggtgatgaagtatattttggataagatagataaagaagaaaaacaggcagcaaaaaaacggaagcgtgaagagagtgtggagcagaaacgtagcaagcagaatgccactaagctgtcagctctgctcttcaagcacaaagagcagctcagagccgagatcctgaagaagagagcactcctggacaaggatctgcaaattgaagtgcaggaagagctgaagagagacctgaaaattaagaaagaaaaagacctgatgcagttggctcaggccacagcagtagctgcaccctgccccccagtgacaccagctcctccagcccctccagcccctccaccttcacctccccctccacctgctgtgcaacacacaggccttctgtccacgcccaccttacctgctgcttcccagaagaggaagcgggaagaggaaaaagactccagctcaaagtccaagaaaaagaaaatgatctctactacctcaaaggaaactaagaaggacacaaagctttactgtatctgtaaaacgccttatgatgaatctaaattttatattggctgtgatcggtgtcagaattggtaccatgggcgctgcgttggcatcttgcaaagtgaggcagagctcattgatgagtatgtctgtccacagtgccagtcaacagaggatgccatgacagtgctcacgccactaacagagaaggattatgaggggttgaagagggtgctccgttccttacaggcccataagatggcctggcctttccttgaaccagtagaccctaatgatgcaccagattattatggtgttattaaggaacctatggaccttgccaccatggaagaaagagtacaaagacgatattatgaaaagctgacggaatttgtggcagatatgaccaaaatttttgataactgtcgttactacaatccaagtgactccccattttaccagtgtgcagaagttctcgaatcattctttgtacagaaattgaaaggcttcaaagctagcaggtctcataacaacaaactgcagtctacagcttcttaa

SEQ ID NO: 8204 - DNA, 171 bp, synthetic construct; identical to SEQ ID NO: 6873
  misc_feature 1..171: note = Synthetic polypeptide
  source 1..171: mol_type = other DNA

SEQ ID NO: 8205 - DNA, 633 bp, synthetic construct; identical to SEQ ID NO: 6874
  misc_feature 1..633: note = Synthetic polypeptide
  source 1..633: mol_type = other DNA

SEQ ID NO: 8206 - DNA, 636 bp, synthetic construct; identical to SEQ ID NO: 6875
  misc_feature 1..636: note = Synthetic polypeptide
  source 1..636: mol_type = other DNA

SEQ ID NO: 8207 - DNA, 480 bp, synthetic construct; identical to SEQ ID NO: 6876
  misc_feature 1..480: note = Synthetic polypeptide
  source 1..480: mol_type = other DNA

SEQ ID NO: 8208 - DNA, 1138 bp, synthetic construct; identical to SEQ ID NO: 7655
  misc_feature 1..1138: note = Synthetic polypeptide
  source 1..1138: mol_type = other DNA

SEQ ID NO: 8209 - DNA, 1164 bp, synthetic construct
  misc_feature 1..1164: note = Synthetic polypeptide
  source 1..1164: mol_type = other DNA
ctccagagccagcctgcctgggtttaaatcatggctttactgcttctctgggatcttagaaagctgcttatcctctctgagcctcagtttctgcatctgttaaatagagacaatggaaggacctccctcttagtgttgcggatattggagagctgattgatgctagaacacttccaagcacgtgtgttggtcacatggcagggcatgaccattcggcccctggtagacctgttggctgtgaagaaaaagcaagagacgaagcgctccatcaacgaagagatccacacacagttcctggaccaccttctgacaggcatcgaagacatctgtggccactacggtcaccaccactggaaggacaagctcaaccggtttaataagaaatatgtgaagaagtgtctgatagctggcgagcgctccaaggagccccagctcattgccttctaccacaagatggagatgaagcaggccatcgagctggtggagagcgggggcatgggcaagatcccctctgccgtctccaccgtctccatgcagaacatccaccccaagtccctgccttccgagcgcatcctgccagcactgtccaaggacaaggaggaggagatccgcaaaatcctgaggaacaacttgcagaagaccaggcagcggctgcggtcctacaacagacacacgctggtggcagacccctacgaggaagcctggaaccagatgctgctccggaggcagaaggcccggcagctggagcagaagatcaacaactacctgacggtgccagcccacaagctggactcacccaccatgtctcgggcccgcatcggctcagacccactggcctatgagccgaaggaggacctgcctgtcatcaccatcgacccggcttccccgcagtcacccgagtctgtggacctggtgaatgaagagctgaagggcaaagtcttagggttgagccgggatcctgcaaaggtggctgaggaggacgaggacgacgatgggggcatcatgatgcggagcaaggagacttcgtccccaggaaccgacgatgtcttcacccccgcgcccagtgacagccccagctcccagaggatacagcgctgcctcagtgacccaggcccacaccctgagcctggggagggagaaccgttcttccccaaggggcagtaa

SEQ ID NO: 8210 - DNA, 761 bp, synthetic construct
  misc_feature 1..761: note = Synthetic polypeptide
  source 1..761: mol_type = other DNA
ttgcccctgcctggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggtttctaa

SEQ ID NO: 8211 - DNA, 797 bp, synthetic construct
  misc_feature 1..797: note = Synthetic polypeptide
  source 1..797: mol_type = other DNA
ttgcccctgcctggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggtttctaa

SEQ ID NO: 8212 - DNA, 881 bp, synthetic construct
  misc_feature 1..881: note = Synthetic polypeptide
  source 1..881: mol_type = other DNA
ttgcccctgcctggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagtgtttagaatctccagtggggaagaggaaaagaagcatgactgttagtacttctcaggacccatctttctcaggattaaaccagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggtttctaa

SEQ ID NO: 8213 - DNA, 543 bp, synthetic construct; identical to SEQ ID NO: 6496
  misc_feature 1..543: note = Synthetic polypeptide
  source 1..543: mol_type = other DNA

SEQ ID NO: 8214 - DNA, 378 bp, synthetic construct; identical to SEQ ID NO: 6497
  misc_feature 1..378: note = Synthetic polypeptide
  source 1..378: mol_type = other DNA

SEQ ID NO: 8215 - DNA, 267 bp, synthetic construct; identical to SEQ ID NO: 6498
  misc_feature 1..267: note = Synthetic polypeptide
  source 1..267: mol_type = other DNA

SEQ ID NO: 8216 - DNA, 416 bp, synthetic construct; identical to SEQ ID NO: 6499
  misc_feature 1..416: note = Synthetic polypeptide
  source 1..416: mol_type = other DNA

SEQ ID NO: 8217 - DNA, 162 bp, synthetic construct; identical to SEQ ID NO: 6500
  misc_feature 1..162: note = Synthetic polypeptide
  source 1..162: mol_type = other DNA

SEQ ID NO: 8218 - DNA, 320 bp, synthetic construct
  misc_feature 1..320: note = Synthetic polypeptide
  source 1..320: mol_type = other DNA
aatataaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggatttgaacttctcgaagagctaccaacacccaagttcagctttggaggcagatctggaaacagtgtagcagcattggttttccaaaaaatgtga

SEQ ID NO: 8219 - DNA, 485 bp, synthetic construct
  misc_feature 1..485: note = Synthetic polypeptide
  source 1..485: mol_type = other DNA
aatataaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggttggagtacagtggcaggattttggctcactgcagccttgacttcctgggctcaagcgatcttttccacttcagcctcccgagtaggtggaactacaggcacacatcatcatgcctggataatttttgtatttttagcagagacgaggttttgccatgttgtccaggctggtctggaactcctgggctcaagtgattctcccacctggcctcccaaagtgctgggattataccatgccaggccctcgttggcattttag

SEQ ID NO: 8220 - DNA, 252 bp, synthetic construct; identical to SEQ ID NO: 7309
  misc_feature 1..252: note = Synthetic polypeptide
  source 1..252: mol_type = other DNA

SEQ ID NO: 8221 - DNA, 554 bp, synthetic construct
  misc_feature 1..554: note = Synthetic polypeptide
  source 1..554: mol_type = other DNA
ccactggagggcaagtggaggaagcccgcatccattacaacataggagccgtaggttagatgaaacccaagaaagaaaactcggaaacaaccctaactcgcagtgccagcatgaagctcccagacaacacagtgaagttgggagagaagctggagagataccacacggccatacggagatcagaatctgtcaagtctcggggtctgccttgcactgagttattcgtggctcctgtgggtgtagccagcaagcgccacctctttgagaaggaactggcgggccagagccgagcagaaccagcctccagccggaaggagaacttgaggctctcaggggttgtgacatcaaggctcaacctgtggatcagcaggacccaggaatctggagatcaggacccccaggaggcacagaaagcatcatctgcaaccgagaggactcagtggggacagaaatctgactcctcgctggacgctgagtccccgctgagactgagcagacgcctccaggatctgtcggcagctgctgttctgagggagagcagagaccatgtctga

SEQ ID NO: 8222 - DNA, 482 bp, synthetic construct
  misc_feature 1..482: note = Synthetic polypeptide
  source 1..482: mol_type = other DNA
ccactggagggcaagtggaggaagcccgcatccattacaacataggagccgtaggttagatgaaacccaagaaagaaaactcggaaacaaccctaactcgcagtgccagcatgaagctcccagacaacacagtgaagttgggagagaagctggagagataccacacggccatacggagatcagaatctgtcaagtctcggggtctgccttgcactgagttattcgtggctcctgtgggtgtagccagcaagcgccacctctttgagaaggaactggcgggccagagccgagcagaaccagcctccagccggaaggagaacttgaggctctcaggggttgtgacatcaaggctcaacctgtggatcagcaggacccaggaatctggagatcaggacccccaggaggcacagaaagcatcatctgcaaccgagaggactcagtggggacagaaatctgactcctcgctggacgctgaggtgtga

SEQ ID NO: 8223 - DNA, 5464 bp, synthetic construct; identical to SEQ ID NO: 7409
  misc_feature 1..5464: note = Synthetic polypeptide
  source 1..5464: mol_type = other DNA

SEQ ID NO: 8224 - DNA, 4444 bp, synthetic construct; identical to SEQ ID NO: 7410
  misc_feature 1..4444: note = Synthetic polypeptide
  source 1..4444: mol_type = other DNA

SEQ ID NO: 8225 - DNA, 574 bp, synthetic construct; identical to SEQ ID NO: 7411
  misc_feature 1..574: note = Synthetic polypeptide
  source 1..574: mol_type = other DNA

SEQ ID NO: 8226 - DNA, 1746 bp, synthetic construct
  misc_feature 1..1746: note = Synthetic polypeptide
  source 1..1746: mol_type = other DNA
gaaaaaagaaaggctcactggagcactttggattccgtattttcagatttggggtgctaaactgcggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatag

SEQ ID NO: 8227 - DNA, 1749 bp, synthetic construct
  misc_feature 1..1749: note = Synthetic polypeptide
  source 1..1749: mol_type = other DNA
gaaaaaagaaaggctcactggagcactttggattccgtattttcagatttggggtgctaaactgcggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatag

SEQ ID NO: 8228 - DNA, 519 bp, synthetic construct
  misc_feature 1..519: note = Synthetic polypeptide
  source 1..519: mol_type = other DNA
gaaaaaagaaaggctcactggagcactttggattccgtattttcagatttggggtgctaaactgcggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctc

SEQ ID NO: 8229 - DNA, 507 bp, synthetic construct
  misc_feature 1..507: note = Synthetic polypeptide
  source 1..507: mol_type = other DNA
ctccccagcacttggtgcctgcctctagcatagcacttaacccttcttactgtcattacttatctccatgtctgtctccccctagagtgtgagctcctcgagggcaggaaccctgtttttattcatctttgtgtcccggtgccaagcacagtgcctggctcatggaatcacccttcggtcatcgtgcagcctgggaagagacctttacctgtggaatccccggatactcaaaggaagcggaggatacacagatgtgattatgatggatgcaacaaagtgtacactaaaagctcccacttgaaagcacacagaagaacacacacaggagaaaaaccctacaaatgtacatgggaagggtgcacatggaagtttgctcggtctgatgaactaacaagacatttccgaaaacatactggaatcaaacctttccagtgcccggactgtgaccgcagcttctcccgttctgaccatcttgccctccataggaaacgccacatgctagtctga

SEQ ID NO: 8230 - DNA, 1133 bp, synthetic construct; identical to SEQ ID NO: 7332
  misc_feature 1..1133: note = Synthetic polypeptide
  source 1..1133: mol_type = other DNA

SEQ ID NO: 8231 - DNA, 1172 bp, synthetic construct; identical to SEQ ID NO: 7333
  misc_feature 1..1172: note = Synthetic polypeptide
  source 1..1172: mol_type = other DNA

SEQ ID NO: 8232 - DNA, 1188 bp, synthetic construct
  misc_feature 1..1188: note = Synthetic polypeptide
  source 1..1188: mol_type = other DNA
tgtaaaggctaattttaggtgtacacttgactgcattaagtaatatccagagagccggtaaagcattatttctgggtctatgagggcgattttggaaaagattgacatttgagccagcagactacgtaaggaagatccactctcactgaatgtgagcgagcaccatccaatcagctgagggcccagatagaacaaaaaggcagaagaaaatcagattcactctctctcttctggagctgaaacaactttcttttcctgccataggacatcaggaccccaggttctctggtcttgggactctgagacttgcaccaggaatcctgcccaggctctcaggcctttggactcagactgagctacttcactggctttcctggttctccagcttgaagatggcagatcgtgggacttctcagcctccataattgagtgagccaattccctggccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcaggtataattcccaatctaatttatgttgttataccaacaatacccctgctcttactgatactggttgcttttggaacctgttgtttccagatgctgcataaaagtaaaggaagaacaaaaactagtccaaaccagtctacactgtggatttcaaagagtaccagaaaagaaagtggcatggaagtataa

SEQ ID NO: 8233 - DNA, 2672 bp, synthetic construct; identical to SEQ ID NO: 6621
  misc_feature 1..2672: note = Synthetic polypeptide
  source 1..2672: mol_type = other DNA

SEQ ID NO: 8234 - DNA, 1767 bp, synthetic construct; identical to SEQ ID NO: 6622
  misc_feature 1..1767: note = Synthetic polypeptide
  source 1..1767: mol_type = other DNA

SEQ ID NO: 8235 - DNA, 1692 bp, synthetic construct; identical to SEQ ID NO: 6623
  misc_feature 1..1692: note = Synthetic polypeptide
  source 1..1692: mol_type = other DNA

SEQ ID NO: 8236 - DNA, 1052 bp, synthetic construct; identical to SEQ ID NO: 447
  misc_feature 1..1052: note = Synthetic polypeptide
  source 1..1052: mol_type = other DNA

SEQ ID NO: 8237 - DNA, 1118 bp, synthetic construct; identical to SEQ ID NO: 448
  misc_feature 1..1118: note = Synthetic polypeptide
  source 1..1118: mol_type = other DNA

SEQ ID NO: 8238 - DNA, 2297 bp, synthetic construct; identical to SEQ ID NO: 7386
  misc_feature 1..2297: note = Synthetic polypeptide
  source 1..2297: mol_type = other DNA

SEQ ID NO: 8239 - DNA, 2447 bp, synthetic construct; identical to SEQ ID NO: 7387
  misc_feature 1..2447: note = Synthetic polypeptide
  source 1..2447: mol_type = other DNA

SEQ ID NO: 8240 - DNA, 2312 bp, synthetic construct; identical to SEQ ID NO: 7388
  misc_feature 1..2312: note = Synthetic polypeptide
  source 1..2312: mol_type = other DNA

SEQ ID NO: 8241 - DNA, 2375 bp, synthetic construct; identical to SEQ ID NO: 7389
  misc_feature 1..2375: note = Synthetic polypeptide
  source 1..2375: mol_type = other DNA

SEQ ID NO: 8242 - DNA, 2093 bp, synthetic construct; identical to SEQ ID NO: 7390
  misc_feature 1..2093: note = Synthetic polypeptide
  source 1..2093: mol_type = other DNA

SEQ ID NO: 8243 - DNA, 2090 bp, synthetic construct; identical to SEQ ID NO: 7391
  misc_feature 1..2090: note = Synthetic polypeptide
  source 1..2090: mol_type = other DNA

SEQ ID NO: 8244 - DNA, 433 bp, synthetic construct
  misc_feature 1..433: note = Synthetic polypeptide
  source 1..433: mol_type = other DNA
cttcaggtgccaaaagtcactttctgccagtccacctccaacttcagccacagctgctgtggactctctggacagctcagagcctcctggtgcaacatggccccgcccaaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctga

SEQ ID NO: 8245 - DNA, 433 bp, synthetic construct
  misc_feature 1..433: note = Synthetic polypeptide
  source 1..433: mol_type = other DNA
cttcaggtgccaaaagtcactttctgccagtccacctccaacttcagccacagctgctgtggactctctggacagctcagagcctcctggtgcaacatggccccgcccaaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcggtaatggccagtctggatga

SEQ ID NO: 8246 - DNA, 1411 bp, synthetic construct
  misc_feature 1..1411: note = Synthetic polypeptide
  source 1..1411: mol_type = other DNA
gactgacaggagtgtggaatggtgcatcggaagacttagactaccgagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctgggccctggaggaggagagcttggtgggcagggagccagaagagaggaagaaaggggttccagaaaagtccccagtcttggagaagtcctccatgccaaagaagacggcacctgaaaagagcctggtctccgataaaacctccatctctgagaaggtgctggcctcagagaagacatctctatcagagaagatagcagtgtcagagaaaagaaacagctcagagaagaagtctgttctagaaaaaaccagtgtctctgagaagtcgctggccccagggatggcactgggctcaggaaggaggctggtgtctgagaaagcttccatctttgagaaggcactggcctcagagaagagcccaactgcagatgctaagccggccccaaagagggccacagcctcagagcagcccctggcgcaggagccgccagcctctgggggaagcccagccaccaccaaggagcagagaggaagggccctccctgggaagaacctgccctctttggcaaagcagggggcttcagaccctccgactgtggcctcccgcctcccacccgtcacactccaggtgaaaatccccagcaaggaggaagaggcagatatgtcctcacccacacagcgaacctacagcagctccctcaaacgctccagccccaggaccatctcctttcggatgaaacccaagaaagaaaactcggaaacaaccctaactcgcagtgccagcatgaagctcccagacaacacagtgaagttgggagagaagctggagagataccacacggccatacggagatcagaatctgtcaagtctcggggtctgccttgcactgagttattcgtggctcctgtgggtgtagccagcaagcgccacctctttgagaaggaactggcgggccagagccgagcagaaccagcctccagccggaaggagaacttgaggctctcaggggttgtgacatcaaggctcaacctgtggatcagcaggacccaggaatctggagatcaggacccccaggaggcacagaaagcatcatctgcaaccgagaggactcagtggggacagaaatctgactcctcgctggacgctgaggtgtga

SEQ ID NO: 8247 - DNA, 886 bp, synthetic construct
  misc_feature 1..886: note = Synthetic polypeptide
  source 1..886: mol_type = other DNA
gggcgcggggcgcgccgccatgggcctggccgggctgcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccaaaaactccaccctcatcttgtgattccaccaatgcagccatcgccaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaa

SEQ ID NO: 8248 - DNA, 225 bp, synthetic construct
  misc_feature 1..225: note = Synthetic polypeptide
  source 1..225: mol_type = other DNA
gggcgcggggcgcgccgccatgggcctggccgggctgcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctga

SEQ ID NO: 8249 - DNA, 751 bp, synthetic construct
  misc_feature 1..751: note = Synthetic polypeptide
  source 1..751: mol_type = other DNA
gggcgcggggcgcgccgccatgggcctggccgggctgcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccaaaaactccaccctcatcttgtgattccaccaatgcagccatcgccaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaatgtgggaactgccaaaccaaa

SEQ ID NO: 8250 - DNA, 1197 bp, synthetic construct
  misc_feature 1..1197: note = Synthetic polypeptide
  source 1..1197: mol_type = other DNA
ggctaaggaaaagagcactgggctgagactcaggagacctggtttctagccccagctgtacctctaattgtaaccttgggagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaa

SEQ ID NO: 8251 - DNA, 199 bp, synthetic construct
  misc_feature 1..199: note = Synthetic polypeptide
  source 1..199: mol_type = other DNA
ggctaaggaaaagagcactgggctgagactcaggagacctggtttctagccccagctgtacctctaattgtaaccttgggagatacaactcgtcaacgaatcaaattcagtgatgacagagtatgcaagagtcaccttctcaactgttgtcctcatgatgtcctttctggaactagaatggatcttggagaatgtctga

SEQ ID NO: 8252 - DNA, 1365 bp, synthetic construct
  misc_feature 1..1365: note = Synthetic polypeptide
  source 1..1365: mol_type = other DNA
tggcaaataggtttcatcatttgtttcagcttagatttgttgacagcggtttcctggagtgctgtcttgagaacgattctgaggaggctcagcaagaaagagtgtttcagttgattggctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtag

SEQ ID NO: 8253 - DNA, 2147 bp, synthetic construct
  misc_feature 1..2147: note = Synthetic polypeptide
  source 1..2147: mol_type = other DNA
ggacggggagggacgaggaggaatggggcgagatggggagggacggagtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctag

SEQ ID NO: 8254 - DNA, 148 bp, synthetic construct; identical to SEQ ID NO: 6388
  misc_feature 1..148: note = Synthetic polypeptide
  source 1..148: mol_type = other DNA

SEQ ID NO: 8255 - DNA, 1100 bp, synthetic construct; identical to SEQ ID NO: 6389
  misc_feature 1..1100: note = Synthetic polypeptide
  source 1..1100: mol_type = other DNA

SEQ ID NO: 8256 - DNA, 464 bp, synthetic construct; identical to SEQ ID NO: 6390
  misc_feature 1..464: note = Synthetic polypeptide
  source 1..464: mol_type = other DNA

SEQ ID NO: 8257 - DNA, 280 bp, synthetic construct; identical to SEQ ID NO: 6391
  misc_feature 1..280: note = Synthetic polypeptide
  source 1..280: mol_type = other DNA

SEQ ID NO: 8258 - DNA, 294 bp, synthetic construct
  misc_feature 1..294: note = Synthetic polypeptide
  source 1..294: mol_type = other DNA
attagccaggcatggtggcacacacctgtggtctcagctactcaggaggctgaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtga

SEQ ID NO: 8259 - DNA, 2132 bp, synthetic construct
  misc_feature 1..2132: note = Synthetic polypeptide
  source 1..2132: mol_type = other DNA
aagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttag

SEQ ID NO: 8260 - DNA, 2183 bp, synthetic construct
  misc_feature 1..2183: note = Synthetic polypeptide
  source 1..2183: mol_type = other DNA
aagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatgtaagtatttttataggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttag

SEQ ID NO: 8261 - DNA, 2198 bp, synthetic construct
  misc_feature 1..2198: note = Synthetic polypeptide
  source 1..2198: mol_type = other DNA
aagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagttcctataacagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatatttggctgtacagggatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttag

SEQ ID NO: 8262 - DNA, 2150 bp, synthetic construct
  misc_feature 1..2150: note = Synthetic polypeptide
  source 1..2150: mol_type = other DNA
aagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatatttggctgtacagggatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttag

SEQ ID NO: 8263 - DNA, 2186 bp, synthetic construct
  misc_feature 1..2186: note = Synthetic polypeptide
  source 1..2186: mol_type = other DNA
aagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatatttggctgtacagggatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttag

SEQ ID NO: 8264 - DNA, 2228 bp, synthetic construct
  misc_feature 1..2228: note = Synthetic polypeptide
  source 1..2228: mol_type = other DNA
aagcagcagcaacagaagaaccagaagtgatcccagatcccgccaagcagacagacagagtggtgaaaatagcaggaattagtgctggaattttggtgttcatcctccttctcctagttgtcatattaattgtaaaaaagaggaggagctactattcttactcctactacctcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagttcctataacagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatatttggctgtacagggatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttag

SEQ ID NO: 8265 - DNA, 1026 bp, synthetic construct
  misc_feature 1..1026: note = Synthetic polypeptide
  source 1..1026: mol_type = other DNA
aagcagcagcaacagaagaaccagaagtgatcccagatcccgccaagcagacagacagagtggtgaaaatagcaggaattagtgctggaattttggtgttcatcctccttctcctagttgtcatattaattgtaaaaaagaggaggagctactattcttactcctactacctcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctg

SEQ ID NO: 8266 - DNA, 806 bp, synthetic construct
  misc_feature 1..806: note = Synthetic polypeptide
  source 1..806: mol_type = other DNA
gccaggcacagtggctcacgccagtaatcccagcactttgggaggccgaggcaggaggatcacttgagcccaggaatctgagaccagcttgagcaatatggcaaaaccctgtcgctacaaaaattacccaggtgtggtggagcacacctgtagtcccaggtgaggacagcaatgacctcatccgacacttcctcatcgagtcgtctgccaaaggagtgcatctcaaaggagcagatgaggagccctactttgggagcctctctgccttcgtgtgccagcattccatcatggccctggccctgccctgcaaactcaccatcccacagagagaactgggaggtgcagatggggcctcggactctacagacagcccagcctcctgccagaagaaatctgcgggctgccacaccctgtacctgagctcagtgagcgtggagaccctgactggagccctggccgtgcagaaagccatctccaccacctttgagagggacatcctccccacgcccaccgtggtccacttcaaagtcacagagcagggcatcactctgactgatgtccagaggaaggtgtttttccggcgccattacccactcaccaccctccgcttctgtggtatggaccctgagcaacggaagtggcagaagtactgcaaaccctcctggatctttgggtttgtggccaagagccagacagagcctcaggagaacgtatgccacctctttgcggagtatgacatggtccagccagcctcgcaggtcatcggcctggtgactgctctgctgcaggacgcagaaaggatgtag

SEQ ID NO: 8267 - DNA, 509 bp, synthetic construct; identical to SEQ ID NO: 7445
  misc_feature 1..509: note = Synthetic polypeptide
  source 1..509: mol_type = other DNA

SEQ ID NO: 8268 - DNA, 2120 bp, synthetic construct; identical to SEQ ID NO: 6752
  misc_feature 1..2120: note = Synthetic polypeptide
  source 1..2120: mol_type = other DNA

SEQ ID NO: 8269 - DNA, 192 bp, synthetic construct
  misc_feature 1..192: note = Synthetic polypeptide
  source 1..192: mol_type = other DNA
gccaggcgtggaggcttacacctgtaatcctagcattttgggaggccaagcccatctgctggcaaggctaagattagaacagctcataggagagtcatgattttgaatcacccagataaaggtggatctccttacgtagcagccaaaataaatgaagcaaaagacttgctagaaacaaccaccaaacattga

SEQ ID NO: 8270 - DNA, 871 bp, synthetic construct; identical to SEQ ID NO: 437
  misc_feature 1..871: note = Synthetic polypeptide
  source 1..871: mol_type = other DNA

SEQ ID NO: 8271 - DNA, 421 bp, synthetic construct; identical to SEQ ID NO: 441
  misc_feature 1..421: note = Synthetic polypeptide
  source 1..421: mol_type = other DNA

SEQ ID NO: 8272 - DNA, 638 bp, synthetic construct; identical to SEQ ID NO: 442
  misc_feature 1..638: note = Synthetic polypeptide
  source 1..638: mol_type = other DNA

SEQ ID NO: 8273 - DNA, 337 bp, synthetic construct; identical to SEQ ID NO: 443
  misc_feature 1..337: note = Synthetic polypeptide
  source 1..337: mol_type = other DNA

SEQ ID NO: 8274 - DNA, 995 bp, synthetic construct
  misc_feature 1..995: note = Synthetic polypeptide
  source 1..995: mol_type = other DNA
acgggctctttctggctcttcccagggcgtccgcatacactgcttccctgcccacacgctttactcatcaggttcccatgaccccttcagcgtcacttcttccaagaagccctccctgatcatctgagcacggcaggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctag

SEQ ID NO: 8275 - DNA, 204 bp, synthetic construct
  misc_feature 1..204: note = Synthetic polypeptide
  source 1..204: mol_type = other DNA
acgggctctttctggctcttcccagggcgtccgcatacactgcttccctgcccacacgctttactcatcaggttcccatgaccccttcagcgtcacttcttccaagaagccctccctgatcatctgagcacggcaggtacatgtacccctccatggatcagctggctgaaatgcttcctggagtccttcaacagtttgggctga

SEQ ID NO: 8276 - DNA, 461 bp, synthetic construct
  misc_feature 1..461: note = Synthetic polypeptide
  source 1..461: mol_type = other DNA
acgggctctttctggctcttcccagggcgtccgcatacactgcttccctgcccacacgctttactcatcaggttcccatgaccccttcagcgtcacttcttccaagaagccctccctgatcatctgagcacggcaggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagcctttcgattaccaggcattggtattagatactgtgatgtgtgcagttacttcttgcagtccttcccttgaccttgtggccttgaagttcctggcactcccagttccagattag

SEQ ID NO: 8277 - DNA, 339 bp, synthetic construct
  misc_feature 1..339: note = Synthetic polypeptide
  source 1..339: mol_type = other DNA
acgggctctttctggctcttcccagggcgtccgcatacactgcttccctgcccacacgctttactcatcaggttcccatgaccccttcagcgtcacttcttccaagaagccctccctgatcatctgagcacggcaggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccg

SEQ ID NO: 8278 - DNA, 308 bp, synthetic construct
  misc_feature 1..308: note = Synthetic polypeptide
  source 1..308: mol_type = other DNA
acgggctctttctggctcttcccagggcgtccgcatacactgcttccctgcccacacgctttactcatcaggttcccatgaccccttcagcgtcacttcttccaagaagccctccctgatcatctgagcacggcaggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaac

SEQ ID NO: 8279 - DNA, 305 bp, synthetic construct
  misc_feature 1..305: note = Synthetic polypeptide
  source 1..305: mol_type = other DNA
acgggctctttctggctcttcccagggcgtccgcatacactgcttccctgcccacacgctttactcatcaggttcccatgaccccttcagcgtcacttcttccaagaagccctccctgatcatctgagcacggcaggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtg

SEQ ID NO: 8280 - DNA, 284 bp, synthetic construct
  misc_feature 1..284: note = Synthetic polypeptide
  source 1..284: mol_type = other DNA
acgggctctttctggctcttcccagggcgtccgcatacactgcttccctgcccacacgctttactcatcaggttcccatgaccccttcagcgtcacttcttccaagaagccctccctgatcatctgagcacggcaggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggag

SEQ ID NO: 8281 - DNA, 247 bp, synthetic construct
  misc_feature 1..247: note = Synthetic polypeptide
  source 1..247: mol_type = other DNA
acgggctctttctggctcttcccagggcgtccgcatacactgcttccctgcccacacgctttactcatcaggttcccatgaccccttcagcgtcacttcttccaagaagccctccctgatcatctgagcacggcaggtacatgtacccctccatggatcagctggctgaaatgcttcctggagtccttcaacagtttgggctgaaaagcattattggcatgggaacaggagcaggcgcctacatcct

SEQ ID NO: 8282 - DNA, 210 bp, synthetic construct
  misc_feature 1..210: note = Synthetic polypeptide
  source 1..210: mol_type = other DNA
acgggctctttctggctcttcccagggcgtccgcatacactgcttccctgcccacacgctttactcatcaggttcccatgaccccttcagcgtcacttcttccaagaagccctccctgatcatctgagcacggcaggtacatgtacccctccatggatcagctggctgaaatgcttcctggagtccttcaacagtttgggctgaaaagca

SEQ ID NO: 8283 - DNA, 149 bp, synthetic construct
  misc_feature 1..149: note = Synthetic polypeptide
  source 1..149: mol_type = other DNA
acgggctctttctggctcttcccagggcgtccgcatacactgcttccctgcccacacgctttactcatcaggttcccatgaccccttcagcgtcacttcttccaagaagccctccctgatcatctgagcacggcaggtacatgtacccc

SEQ ID NO: 8284 - DNA, 632 bp, synthetic construct
  misc_feature 1..632: note = Synthetic polypeptide
  source 1..632: mol_type = other DNA
tgcagtcctaaaaaggaatgagatcatgtcctttacaggaacatggatggagctggaagccgttgcaggagcagaaaaccaaacaccgcaagttctcacttataagtaggagctgaacgatgagaacacatggacacaagcggggaaacaacacacactggggcctggtcggggacggagagcatcaggaagattagctaatggatgctgggcttgataccaaggtgatggtgaacgggagcctcttcgtgcagtacttccaccgcgtgcccttccaccgtgtggacaccatctccgtcaatggctctgtgcagctgtcctacatcagcttccagcctcccagcgtgcggcctgccaacccagctcccattacccagacagtcatccacacggtgcagagtgcctctggacagatgttctctactcccgccatcccacctatgatgtacccccaccctgcctatccgatgcctttcatcaccaccattccgggagggctgtacccatccaagtccatcatcctgtcaggcactgtcctgcccagtgctcagaggtgtggatcttgtgtgaagctcactgcctcaaggtggccgtggatggtcagcacgtgtttgaatactaccatcgcctga

SEQ ID NO: 8285 - DNA, 416 bp, synthetic construct
  misc_feature 1..416: note = Synthetic polypeptide
  source 1..416: mol_type = other DNA
tgcagtcctaaaaaggaatgagatcatgtcctttacaggaacatggatggagctggaagccgttgcaggagcagaaaaccaaacaccgcaagttctcacttataagtaggagctgaacgatgagaacacatggacacaagcggggaaacaacacacactggggcctggtcggggacggagagcatcaggaagattagctaatggatgctgggcttgataccaaggtgatggtgaacgggagcctcttcgtgcagtacttccaccgcgtgcccttccaccgtgtggacaccatctccgtcaatggctctgtgcagctgtcctacatcagcttccagccgatgcctttcatcaccaccattccgggagggctgtacccatccaagtccatcatcctgtcaggcactgtcctgcccagt

SEQ ID NO: 8286 - DNA, 962 bp, synthetic construct
  misc_feature 1..962: note = Synthetic polypeptide
  source 1..962: mol_type = other DNA
tgcagtcctaaaaaggaatgagatcatgtcctttacaggaacatggatggagctggaagccgttgcaggagcagaaaaccaaacaccgcaagttctcacttataagtaggagctgaacgatgagaacacatggacacaagcggggaaacaacacacactggggcctggtcggggacggagagcatcaggaagattagctaatggatgctgggcttgataccaaggtgatggtgaacgggagcctcttcgtgcagtacttccaccgcgtgcccttccaccgtgtggacaccatctccgtcaatggctctgtgcagctgtcctacatcagcttccagaatccccgcgcagtccccgttcagcctgccttctccacggtgccgttctcccagcctgtctgtttcccacccaggcccagggggcgcagacaaaaacctcccagcgtgcggcctgccaacccagctcccattacccagacagtcatccacacggtgcagagtgcctctggacagatgttctctcagactcccgccatcccacctatgatgtacccccaccctgcctatccgatgcctttcatcaccaccattccgggagggctgtacccatccaagtccatcatcctgtcaggcactgtcctgcccagtgctcagaggttccacatcaacctgtgctctgggagccacatcgccttccacatgaacccccgttttgatgagaatgctgtggtccgtaacacccagatcaacaactcttgggggtctgaggagcgaagtctgccccgaaaaatgcccttcgtccgaggccagagcttctcggtgtggatcttgtgtgaagctcactgcctcaaggtggccgtggatggtcagcacgtgtttgaatactaccatcgcctgaggaacctgcccaccatcaacaaactggaagtgggtggcgacatccagctgacccacgtgcagacatag

SEQ ID NO: 8287 - DNA, 863 bp, synthetic construct
  misc_feature 1..863: note = Synthetic polypeptide
  source 1..863: mol_type = other DNA
tgcagtcctaaaaaggaatgagatcatgtcctttacaggaacatggatggagctggaagccgttgcaggagcagaaaaccaaacaccgcaagttctcacttataagtaggagctgaacgatgagaacacatggacacaagcggggaaacaacacacactggggcctggtcggggacggagagcatcaggaagattagctaatggatgctgggcttgataccaaggtgatggtgaacgggagcctcttcgtgcagtacttccaccgcgtgcccttccaccgtgtggacaccatctccgtcaatggctctgtgcagctgtcctacatcagcttccagcctcccagcgtgcggcctgccaacccagctcccattacccagacagtcatccacacggtgcagagtgcctctggacagatgttctctactcccgccatcccacctatgatgtacccccaccctgcctatccgatgcctttcatcaccaccattccgggagggctgtacccatccaagtccatcatcctgtcaggcactgtcctgcccagtgctcagaggttccacatcaacctgtgctctgggagccacatcgccttccacatgaacccccgttttgatgagaatgctgtggtccgtaacacccagatcaacaactcttgggggtctgaggagcgaagtctgccccgaaaaatgcccttcgtccgaggccagagcttctcggtgtggatcttgtgtgaagctcactgcctcaaggtggccgtggatggtcagcacgtgtttgaatactaccatcgcctgaggaacctgcccaccatcaacaaactggaagtgggtggcgacatccagctgacccacgtgcagacatag

SEQ ID NO: 8288 - DNA, 596 bp, synthetic construct
  misc_feature 1..596: note = Synthetic polypeptide
  source 1..596: mol_type = other DNA
tgcagtcctaaaaaggaatgagatcatgtcctttacaggaacatggatggagctggaagccgttgcaggagcagaaaaccaaacaccgcaagttctcacttataagtaggagctgaacgatgagaacacatggacacaagcggggaaacaacacacactggggcctggtcggggacggagagcatcaggaagattagctaatggatgctgggcttgataccaaggtgatggtgaacgggagcctcttcgtgcagtacttccaccgcgtgcccttccaccgtgtggacaccatctccgtcaatggctctgtgcagctgtcctacatcagcttccagacccagacagtcatccacacggtgcagagtgcctctggacagatgttctctactcccgccatcccacctatgatgtacccccaccctgcctatccgatgcctttcatcaccaccattccgggagggctgtacccatccaagtccatcatcctgtcaggcactgtcctgcccagtgctcagaggtgtggatcttgtgtgaagctcactgcctcaaggtggccgtggatggtcagcacgtgtttgaatactaccatcgcctga

SEQ ID NO: 8289 - DNA, 1965 bp, synthetic construct
  misc_feature 1..1965: note = Synthetic polypeptide
  source 1..1965: mol_type = other DNA
ggacaggtgcatggctcacacctataatcccagtgctttgggaggccgaagtggtaggatcgcttgagcccaggagtttgagaccagcctgggcaacaaagtgagacccttgtctctacaaaaaatacaaaaattagctgagtgtggtggtgcatacctgcagttccacctacttgggaggctgaggtggcaggatcgcttgagttgaggagatggaggctgcagtgaactgcgatcacgccactgcattccagcctgggcaacagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctga

SEQ ID NO: 8290 - DNA, 1031 bp, synthetic construct
  misc_feature 1..1031: note = Synthetic polypeptide
  source 1..1031: mol_type = other DNA
gccaggtgcagtggctcgtgcctgtaatcctagcactttgggtggccaaggtgggaggattgcttgagcccaggagttcaagaccagccttggcaacatgaaacatctttttgaaaatatcaatcattggcattctttgttactattggctcaacaccgtggccctgtctggtgaagagtgttgggaaaccctcattggccaggacatctaccggctccttctgatggattttgtgttctctttagtcaattccttcctgggggagtttctgaggagaatcattgggatgcaactgatcacaagtcttggccttcaggagtttgacattgccaggaacgttctagaactgatctatgcacaaactctggtgtggattggcatcttcttctgccccctgctgccctttatccaaatgattatgcttttcatcatgttctactccaaaaatatcagcctgatgatgaatttccagcctccgagcaaagcctggcgggcctcacagatgatgactttcttcatcttcttgctctttttcccatccttcaccggggtcttgtgcaccctggccatcaccatctggagattgaagccttcagctgactgtggcccttttcgaggtctgcctctcttcattcactccatctacagctggatcgacaccctaagtacacggcctggctacctgtgggttgtttggatctatcggaacctcattggaagtgtgcacttctttttcatcctcaccctcattgtgctaatcatcacctatctttactggcagatcacagagggaaggaagattatgataaggctgctccatgagcagatcattaatgagggcaaagataaaatgttcctgatagaaaaattgatcaagctgcaggatatggagaagaaagcaaaccccagctcacttgttctggaaaggagagaggtggagcaacaaggctttttgcatttgggggaacatgatggcagtcttgacttgcgatctagaagatcagttcaagaaggtaatccaagggcctga

SEQ ID NO: 8291 - DNA, 857 bp, synthetic construct
  misc_feature 1..857: note = Synthetic polypeptide
  source 1..857: mol_type = other DNA
gccaggtgcagtggctcgtgcctgtaatcctagcactttgggtggccaaggtgggaggattgcttgagcccaggagttcaagaccagccttggcaacatgaaacatctttttgaaaatatcaatcattggcattctttgttactattggctcaacaccgtggccctgtctggtgaagagtgttgggaaaccctcattggccaggacatctaccggctccttctgatggattttgtgttctctttagtcaattccttcctgggggagtttctgaggagaatcattgggatgcaactgatcacaagtcttggccttcaggagtttgacattgccaggaacgttctagaactgatctatgcacaaactctggtgtggattggcatcttcttctgccccctgctgccctttatccaaatgattatgcttttcatcatgttctactccaaaaatatcagcctgatgatgaatttccagcctccgagcaaagcctggcgggcctcacagatgatgactttcttcatcttcttgctctttttcccatccttcaccggggtcttgtgcaccctggccatcaccatctggagaatcatcacctatctttactggcagatcacagagggaaggaagattatgataaggctgctccatgagcagatcattaatgagggcaaagataaaatgttcctgatagaaaaattgatcaagctgcaggatatggagaagaaagcaaaccccagctcacttgttctggaaaggagagaggtggagcaacaaggctttttgcatttgggggaacatgatggcagtcttgacttgcgatctagaagatcagttcaagaaggtaatccaagggcctga

SEQ ID NO: 8292 - DNA, 80 bp, synthetic construct; identical to SEQ ID NO: 6364
  misc_feature 1..80: note = Synthetic polypeptide
  source 1..80: mol_type = other DNA

SEQ ID NO: 8293 - DNA, 217 bp, synthetic construct; identical to SEQ ID NO: 6365
  misc_feature 1..217: note = Synthetic polypeptide
  source 1..217: mol_type = other DNA

SEQ ID NO: 8294 - DNA, 330 bp, synthetic construct; identical to SEQ ID NO: 6490
  misc_feature 1..330: note = Synthetic polypeptide
  source 1..330: mol_type = other DNA

SEQ ID NO: 8295 - DNA, 353 bp, synthetic construct
  misc_feature 1..353: note = Synthetic polypeptide
  source 1..353: mol_type = other DNA
gggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatag

SEQ ID NO: 8296 - DNA, 421 bp, synthetic construct
  misc_feature 1..421: note = Synthetic polypeptide
  source 1..421: mol_type = other DNA
gggtggagccaagatggccgaataggaacagctccagtctacagctcccagcatgagcgacacagaagacgggtgctttctgcatttccagctgaggttacagtcttcttcataccttgatgattcgagtccaacaggtttaatgaaagatactcatactgtaaactgcaggagtatgtcaaataaggagttgtttccaccaagtccttctgaaatgggggagctagaggctaccaggcaaaaccagagtactgttgctgtccacagccatgagccactcctcagtgatggtgcacagttggatttcgatgccctatgtgacaatgatgacacagccatggctgcatttatgaattacttagaagcagaggggggcctgggagaccctggggacttcagtgacatccagtggaccctctag

SEQ ID NO: 8297 - DNA, 244 bp, synthetic construct
  misc_feature 1..244: note = Synthetic polypeptide
  source 1..244: mol_type = other DNA
gggtggagccaagatggccgaataggaacagctccagtctacagctcccagcatgagcgacacagaagacgggtgctttctgcatttccagctgaggttacagtcttcttcataccttgatgattcgagtccaacaggtttaatgaaagatactcatactgtaaactgcaggagtgtgatggtgcacagttggatttcgatgccctatgtgacaatgatgacacagccatggctgcatttatga

SEQ ID NO: 8298 - DNA, 303 bp, synthetic construct; identical to SEQ ID NO: 6723
  misc_feature 1..303: note = Synthetic polypeptide
  source 1..303: mol_type = other DNA

SEQ ID NO: 8299 - DNA, 189 bp, synthetic construct; identical to SEQ ID NO: 6724
  misc_feature 1..189: note = Synthetic polypeptide
  source 1..189: mol_type = other DNA

SEQ ID NO: 8300 - DNA, 318 bp, synthetic construct; identical to SEQ ID NO: 6725
  misc_feature 1..318: note = Synthetic polypeptide
  source 1..318: mol_type = other DNA

SEQ ID NO: 8301 - DNA, 138 bp, synthetic construct; identical to SEQ ID NO: 6726
  misc_feature 1..138: note = Synthetic polypeptide
  source 1..138: mol_type = other DNA

SEQ ID NO: 8302 - DNA, 2448 bp, synthetic construct; identical to SEQ ID NO: 6618
  misc_feature 1..2448: note = Synthetic polypeptide
  source 1..2448: mol_type = other DNA

SEQ ID NO: 8303 - DNA, 1543 bp, synthetic construct; identical to SEQ ID NO: 6619
  misc_feature 1..1543: note = Synthetic polypeptide
  source 1..1543: mol_type = other DNA

SEQ ID NO: 8304 - DNA, 1468 bp, synthetic construct; identical to SEQ ID NO: 6620
  misc_feature 1..1468: note = Synthetic polypeptide
  source 1..1468: mol_type = other DNA

SEQ ID NO: 8305 - DNA, 1498 bp, synthetic construct
  misc_feature 1..1498: note = Synthetic polypeptide
  source 1..1498: mol_type = other DNA
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggaggtgaggagcgtcgctgcccggccgccccgtctgagaagtgaggagcccctccgcccggcagccgccccgtctgggaagtgaggagcgtctccgcccggcagccaccccgtccgggaaggaggtgggggtcagcccccgccaggccagccgccccatccgggagggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactga

SEQ ID NO: 8306 - DNA, 1195 bp, synthetic construct
  misc_feature 1..1195: note = Synthetic polypeptide
  source 1..1195: mol_type = other DNA
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggaggtgaggagcgtcgctgcccggccgccccgtctgagaagtgaggagcccctccgcccggcagccgccccgtctgggaagtgaggagcgtctccgcccggcagccaccccgtccgggaaggaggtgggggtcagcccccgccaggccagccgccccatccgggagggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtttcttcgtttgagtcagtcgccttga

SEQ ID NO: 8307 - DNA, 1462 bp, synthetic construct
  misc_feature 1..1462: note = Synthetic polypeptide
  source 1..1462: mol_type = other DNA
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggaggtgaggagcgtcgctgcccggccgccccgtctgagaagtgaggagcccctccgcccggcagccgccccgtctgggaagtgaggagcgtctccgcccggcagccaccccgtccgggaaggaggtgggggtcagcccccgccaggccagccgccccatccgggagggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagtcgttccccatcaggaagtcctcgcagaagtgcaagtcctgaaagaatggactga

SEQ ID NO: 8308 - DNA, 1489 bp, synthetic construct
  misc_feature 1..1489: note = Synthetic polypeptide
  source 1..1489: mol_type = other DNA
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggaggtgaggagcgtcgctgcccggccgccccgtctgagaagtgaggagcccctccgcccggcagccgccccgtctgggaagtgaggagcgtctccgcccggcagccaccccgtccgggaaggaggtgggggtcagcccccgccaggccagccgccccatccgggagggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgagatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactga

SEQ ID NO: 8309 - DNA, 1180 bp, synthetic construct
  misc_feature 1..1180: note = Synthetic polypeptide
  source 1..1180: mol_type = other DNA
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggaggtgaggagcgtcgctgcccggccgccccgtctgagaagtgaggagcccctccgcccggcagccgccccgtctgggaagtgaggagcgtctccgcccggcagccaccccgtccgggaaggaggtgggggtcagcccccgccaggccagccgccccatccgggagggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtatttattttaa

SEQ ID NO: 8310 - DNA, 1110 bp, synthetic construct
  misc_feature 1..1110: note = Synthetic polypeptide
  source 1..1110: mol_type = other DNA
ggccaggcgcagtggctcactcctgtaatcccagcactttgggaggccgaggcaggaggatcatttgaggtcaagagttcaagaccagcctgaccaacaagggaggaggtacaggagaactgtgtgcggtggcgaaagaggttcaccttcgtgtgtaagatgagtgctaacccggccaccggcctgctggacccctgtgtcttccgtgtgtctgtgcgcaaggagctgaaaggcgggaaggcttattccaagctgggcttcgctgacttgaacctggccgagtttgcgggctcgggctccacggtgcgctgctgcctgctcgagggatatgacacgaagaacactcgccaggacaactccatccttaaggtcaccattggtatgttcctgctctctggagatccctgcttcaagacgccaccatcgactgccaagtccatctccatcccaggccaggattcctccctgcagctgacgtgtaagggtggtgggaccagcagtgggggcagcagcaccaactccctgactgggtcccggccccccaaggctcggcccactattctcagctcagggctgccagaggaacccgaccagaacctgtccagccctgaggaggtgttccactctggccactcccgcaactccagctatgccagccagcagtccaagatctccggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggcggaagaaggactcggtggagagccacccgacctgggtggacgacacgcggatcgatgcggatgccatcgtggagaagatcgtgcagagccaggatttcacagatggcagcaacaccgaggacagcaacctccggctgttcgtgagccgcgatggctctgccacgctgagcggcatccagcttgccaccagggtctcttctggggtctacgagccagttgtgattgaaagccattga

SEQ ID NO: 8311 - DNA, 2887 bp, synthetic construct
  misc_feature 1..2887: note = Synthetic polypeptide
  source 1..2887: mol_type = other DNA
ggccgggcgcagtggctcacgcctgtaatgccagcactttaggaggcaaaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaagttcaatctcatccctcccagcagctccccttccaccccccggggaactga

SEQ ID NO: 8312 - DNA, 2941 bp, synthetic construct
  misc_feature 1..2941: note = Synthetic polypeptide
  source 1..2941: mol_type = other DNA
ggccgggcgcagtggctcacgcctgtaatgccagcactttaggaggcaaaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcctccccttccaccccccggggaactgaagattgtcctggccgcgacctga

SEQ ID NO: 8313 - DNA, 2980 bp, synthetic construct
  misc_feature 1..2980: note = Synthetic polypeptide
  source 1..2980: mol_type = other DNA
ggccgggcgcagtggctcacgcctgtaatgccagcactttaggaggcaaaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcgtgagttctcattagctgggggaatttggcatggaagagctgaggggctgcaggtggggcaggatgcacgggttctgggtggggagtga

SEQ ID NO: 8314 - DNA, 2887 bp, synthetic construct
  misc_feature 1..2887: note = Synthetic polypeptide
  source 1..2887: mol_type = other DNA
ggccgggcgcagtggctcacgcctgtaatgccagcactttaggaggcaaaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaagctccccttccaccccccggggaactgaagattgtcctggccgcgacctga

SEQ ID NO: 8315 - DNA, 3046 bp, synthetic construct
  misc_feature 1..3046: note = Synthetic polypeptide
  source 1..3046: mol_type = other DNA
ggccgggcgcagtggctcacgcctgtaatgccagcactttaggaggcaaaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattctatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttag

SEQ ID NO: 8316 - DNA, 2959 bp, synthetic construct
  misc_feature 1..2959: note = Synthetic polypeptide
  source 1..2959: mol_type = other DNA
ggccgggcgcagtggctcacgcctgtaatgccagcactttaggaggcaaaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagctcccccttttcttccagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcttcaatctcatccctcccagcagctccccttccaccccccggggaactga

SEQ ID NO: 8317 - DNA, 2941 bp, synthetic construct
  misc_feature 1..2941: note = Synthetic polypeptide
  source 1..2941: mol_type = other DNA
ggccgggcgcagtggctcacgcctgtaatgccagcactttaggaggcaaaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcttcaatctcatccctcccagcagctccccttccaccccccggggaactga

SEQ ID NO: 8318 - DNA, 940 bp, synthetic construct
  misc_feature 1..940: note = Synthetic polypeptide
  source 1..940: mol_type = other DNA
ggccgggcgcagtggctcacgcctgtaatgccagcactttaggaggcaaaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttct

SEQ ID NO: 8319 - DNA, 1571 bp, synthetic construct; identical to SEQ ID NO: 6810
  misc_feature 1..1571: note = Synthetic polypeptide
  source 1..1571: mol_type = other DNA

SEQ ID NO: 8320 - DNA, 309 bp, synthetic construct
  misc_feature 1..309: note = Synthetic polypeptide
  source 1..309: mol_type = other DNA
ggccgggcacggtggctcacgcctataatcccagcactttgggaggccgaggcgggtggatcacaaggccgctgtgcccccatgaagagcatctccagcagcctcaaggagaccatgaacccgcacgacatcgtgcaggacgccatccacaacttctcacctgcctaccagcagtacacgcagcagtccaccctggagcctgggcccacctggcgtggtggcgcccacggcctctcccgctcccacagcctcagtggcgcccgcgacaacgagaagactctcctgctcagctctgatgatgaattctag

SEQ ID NO: 8321 - DNA, 163 bp, synthetic construct
  misc_feature 1..163: note = Synthetic polypeptide
  source 1..163: mol_type = other DNA
gaaaaaagaaaggctcactggagcactttggattccgtattttcagatttggggtgctaaactgcggagctgcccaagccctccatctccagcaacaactccaaacccgtggaggacaaggatgctgtggccttcacctgtgaacctgaggctcagaacacaa

SEQ ID NO: 8322 - DNA, 681 bp, synthetic construct
  misc_feature 1..681: note = Synthetic polypeptide
  source 1..681: mol_type = other DNA
gaaaaaagaaaggctcactggagcactttggattccgtattttcagatttggggtgctaaactgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatag

SEQ ID NO: 8323 - DNA, 295 bp, synthetic construct
  misc_feature 1..295: note = Synthetic polypeptide
  source 1..295: mol_type = other DNA
tttggcgtgcaacatggggcttgagaaaggtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgca

SEQ ID NO: 8324 - DNA, 1117 bp, synthetic construct
  misc_feature 1..1117: note = Synthetic polypeptide
  source 1..1117: mol_type = other DNA
tttggcgtgcaacatggggcttgagaaaggtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtga

SEQ ID NO: 8325 - DNA, 931 bp, synthetic construct
  misc_feature 1..931: note = Synthetic polypeptide
  source 1..931: mol_type = other DNA
tttggcgtgcaacatggggcttgagaaaggtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggaatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtag

SEQ ID NO: 8326 - DNA, 336 bp, synthetic construct; identical to SEQ ID NO: 7520
  misc_feature 1..336: note = Synthetic polypeptide
  source 1..336: mol_type = other DNA

SEQ ID NO: 8327 - DNA, 346 bp, synthetic construct; identical to SEQ ID NO: 7521
  misc_feature 1..346: note = Synthetic polypeptide
  source 1..346: mol_type = other DNA

SEQ ID NO: 8328 - DNA, 630 bp, synthetic construct
  misc_feature 1..630: note = Synthetic polypeptide
  source 1..630: mol_type = other DNA
tgggttcaaatgctggttctgcaatttaccttctgccttaccaaaaggacccgctacatcagcacggagctgggcatcaggcagaggctgctggtggcggtgctgacctctcagaccacgctgcccacgctgggcgtggccgtgaaccgcacgctggggcaccggctggagcgtgtggtgttcctgacgggcgcacggggccgccgggccccacctggcatggcagtggtgacgctaggcgaggagcgacccattggacacctgcacctggcgctgcgccacctgctggagcagcacggcgacgactttgactggttcttcctggtgcctgacaccacctacaccgaggcgcacggcctggcacgcctaactggccacctcagcctggcctccgccgcccacctgtacctgggccggccccaggacttcatcggcggagagcccacccccggccgctactgccacggaggctttggggtgctgctgtcgcgcatgctgctgcaacaactgcgcccccacctggaaggctgccgcaacgacatcgtcagtgcgcgccctgacgagtggctgggtcgctgcattctcgatgccaccggggtgggctgcactggtgaccacgaggtgggatga

SEQ ID NO: 8329 - DNA, 2061 bp, synthetic construct
  misc_feature 1..2061: note = Synthetic polypeptide
  source 1..2061: mol_type = other DNA
tgggttcaaatgctggttctgcaatttaccttctgccttaccaaaaggacccgctacatcagcacggagctgggcatcaggcagaggctgctggtggcggtgctgacctctcagaccacgctgcccacgctgggcgtggccgtgaaccgcacgctggggcaccggctggagcgtgtggtgttcctgacgggcgcacggggccgccgggccccacctggcatggcagtggtgacgctaggcgaggagcgacccattggacacctgcacctggcgctgcgccacctgctggagcagcacggcgacgactttgactggttcttcctggtgcctgacaccacctacaccgaggcgcacggcctggcacgcctaactggccacctcagcctggcctccgccgcccacctgtacctgggccggccccaggacttcatcggcggagagcccacccccggccgctactgccacggaggctttggggtgctgctgtcgcgcatgctgctgcaacaactgcgcccccacctggaaggctgccgcaacgacatcgtcagtgcgcgccctgacgagtggctgggtcgctgcattctcgatgccaccggggtgggctgcactggtgaccacgagggggtgcactatagccatctggagctgagccctggggagccagtgcaggagggggaccctcatttccgaagtgccctgacagcccaccctgtgcgtgaccctgtgcacatgtaccagctgcacaaagctttcgcccgagctgaactggaacgcacgtaccaggagatccaggagttacagtgggagatccagaataccagccatctggccgttgatggggaccaggcagctgcttggcccgtgggtattccagcaccatcccgcccggcctcccgctttgaggtgctgcgctgggactacttcacggagcagcacgctttctcctgcgccgatggctcaccccgctgcccactgcgtggggctgaccgggctgatgtggccgatgttctggggacagctctagaggagctgaaccgccgctaccacccggccttgcggctccagaagcagcagctggtgaatggctaccgacgctttgatccggcccggggtatggaatacacgctggacttgcagctggaggcactgaccccccagggaggccgccggcccctcactcgccgagtgcagctgctccggccgctgagccgcgtggagatcttgcctgtgccctatgtcactgaggcctcacgtctcactgtgctgctgcctctagctgcggctgagcgtgacctggcccctggcttcttggaggcctttgccactgcagcactggagcctggtgatgctgcggcagccctgaccctgctgctactgtatgagccgcgccaggcccagcgcgtggcccatgcagatgtcttcgcacctgtcaaggcccacgtggcagagctggagcggcgtttccccggtgcccgggtgccatggctcagtgtgcagacagccgcaccctcaccactgcgcctcatggatctactctccaagaagcacccgctggacacactgttcctgctggccgggccagacacggtgctcacgcctgacttcctgaaccgctgccgcatgcatgccatctccggctggcaggccttctttcccatgcatttccaagccttccacccagctgtggccccaccacaagggcctgggcccccagagctgggccgtgacactggccgctttgatcgccaggcagccagcgaggcctgcttctacaactccgactatgtggcagcccgtgggcgcctggcggcagcctcagaacaagaagaggagctgctggagagcctggatgtgtacgagctgttcctccacttctccagtctgcatgtgctgcgggcggtggagccggcgctgctgcagcgctaccgggcccagacgtgcagcgcgaggctcagtgaggacctgtaccaccgctgcctccagagcgtgcttgagggcctcggctcccgaacccagctggccatgctactctttgaacaggagcagggcaacagcacctga

SEQ ID NO: 8330 - DNA, 100 bp, synthetic construct
  misc_feature 1..100: note = Synthetic polypeptide
  source 1..100: mol_type = other DNA
gccgggtgcagtggctcactcctgtaatcccagcactttgggaggccgatgcaggaaacgccagacttctatcctcattcaaaaatctgggccttgctga

SEQ ID NO: 8331 - DNA, 418 bp, synthetic construct
  misc_feature 1..418: note = Synthetic polypeptide
  source 1..418: mol_type = other DNA
ggccaggcgcggtggctcacacctgtaatccggcgctcaggaggccaaagtgggaggatcgcttgaggccaggagttccagaccagcctgggcaaaatagcaagatccccatctctgcaaaaaagtaaaacaattagctgggcatgatggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcaagactgggtttcaccgtgttagccaggatggtcttgatctcctgacctcgtga

SEQ ID NO: 8332 - DNA, 488 bp, synthetic construct
  misc_feature 1..488: note = Synthetic polypeptide
  source 1..488: mol_type = other DNA
ggccaggcgcggtggctcacacctgtaatccggcgctcaggaggccaaagtgggaggatcgcttgaggccaggagttccagaccagcctgggcaaaatagcaagatccccatctctgcaaaaaagtaaaacaattagctgggcatgatggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcactactctgacccatggatcccctgggcccagccaagccacagtggctgtggcgccgctgtctggccgggctgctgtttcagctgctggtggctgtgtgtttcttctcctacctgcgtgtgtcc

SEQ ID NO: 8333 - DNA, 563 bp, synthetic construct
  misc_feature 1..563: note = Synthetic polypeptide
  source 1..563: mol_type = other DNA
ggccaggcgcggtggctcacacctgtaatccggcgctcaggaggccaaagtgggaggatcgcttgaggccaggagttccagaccagcctgggcaaaatagcaagatccccatctctgcaaaaaagtaaaacaattagctgggcatgatggcctgaccgccgctgcctacagagtcacactcaatcctccgggcaccttccttgaaggagtggctaaggttggacaatacacgttcactgcagacactggcagtgagcgcccaagaggctcctgctgtgcccgtctcgaggcccttgctcttcccgtctaccccgcagctgctgtcggggccgtgtttggcctcaccacctgcatcagcgcccatgtccgcgagaagcccgacgaccccctgaactacttcctcggtggctgcgccggaggcctgactctgggagcacgcactactctgacccatggatcccctgggcccagccaagccacagtggctgtggcgccgctgtctggccgggctgctgtttcagctgctggtggctgtgtgtttcttctcctacctgcgtgtgtcc

SEQ ID NO: 8334 - DNA, 739 bp, synthetic construct
  misc_feature 1..739: note = Synthetic polypeptide
  source 1..739: mol_type = other DNA
ggccaggcgcggtggctcacacctgtaatccggcgctcaggaggccaaagtgggaggatcgcttgaggccaggagttccagaccagcctgggcaaaatagcaagatccccatctctgcaaaaaagtaaaacaattagctgggcatgatggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcaagacaggatctcactgtgttgtgcaggctggtctcaaactcctggcctcgagcagtcctcacacctcagcctcccagagtgctgggattataggcatgagccactgtgtacagagattctgggtcccttcttccagcgcctgcctcgaagtcctctctggagagagcacagatgtccacgcgtgttccagcacaaggggggcatgcaacagctcagggtcacgtccacttccggagctgggtgcccgggcctcgggctccctgagaaagggcggacacacccaccccgcacccagaggggcaggggccctgacacctgtccaagccctaatagagtcattgttaaacactctgggttcgaaccccagaacttga

SEQ ID NO: 8335 - DNA, 415 bp, synthetic construct
  misc_feature 1..415: note = Synthetic polypeptide
  source 1..415: mol_type = other DNA
ggccaggcgcggtggctcacacctgtaatccggcgctcaggaggccaaagtgggaggatcgcttgaggccaggagttccagaccagcctgggcaaaatagcaagatccccatctctgcaaaaaagtaaaacaattagctgggcatgatggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcagtgagtggccccctccccacccccaccctcctcccagcctggcagaatga

SEQ ID NO: 8336 - DNA, 478 bp, synthetic construct
  misc_feature 1..478: note = Synthetic polypeptide
  source 1..478: mol_type = other DNA
ggccaggcgcggtggctcacacctgtaatccggcgctcaggaggccaaagtgggaggatcgcttgaggccaggagttccagaccagcctgggcaaaatagcaagatccccatctctgcaaaaaagtaaaacaattagctgggcatgatggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcacgcacaactacgggattggcgccgccgcctgcgtgtactttggcatagcggcctccctggtcaagatgggccggctggagggctgggaggtgtttgcaaaacccaaggtgtga

SEQ ID NO: 8337 - DNA, 4233 bp, synthetic construct
  misc_feature 1..4233: note = Synthetic polypeptide
  source 1..4233: mol_type = other DNA
agcctccaagatagctctgaatgatccttatttccttgtatttactcccttgtatagtcccctgcaacactgaacggggctgtcctgagtaacggaacaggctgtggtagaagtgacaatgtatgcttttcaaggttaggtcgtaaaagactgccacttcatatttgctctcttggatcttgcaccaggggaaaaccaactgccttttcacttgagctgtctagaaaggcccatgtagtgtggaactgaagcctttcaacaacagcaagtgtcaacttagaaccgtaagaatgagttaccttcaaaacacaccctccacgcccagtcaagccttcagataactgcagccttgaccagatggtagtgaaaacctttatggatatggatcaggactcagaagatgaaaaacagcagtatctcccactagccttgcatcttgcatctgaattcttcctcaggaaccccaataaagatgtgcgtctccttgtagcatgttgtttggctgatatctttcgtatctatgccccagaagctccatatacttcccatgataaacttaaggacatatttttgtttattaccagacaattaaaaggtttggaggatacaaagagtccacagtttaatagatacttttatttattagagaatttagcttgggttaaatcatataacatctgctttgaattggaagattgcaatgaaatttttattcagctttttagaactctcttctcagtgatcaacaatagccacaataagaaggtacaaatgcacatgctagatttgatgagttctatcatcatggaaggtgatggagttactcaagaattattggactccattcttattaacctcattcctgcacataagaacttaaataaacagtcctttgaccttgcaaaagtgctattgaaaagaacagtccagactattgaggcatgcattgctaattttttcaatcaagtcctggtgctgggaagatcatcagtaagtgatttgtcagaacatgtatttgatctgattcaggaactttttgctatagatcctcatttattattatccgtcatgccacagcttgaattcaaactaaagagcaatgatggagaagagcgattagctgttgttcgacttctagctaaattgtttggctccaaagattctgatttggcaacacagaatcgtcctctttggcaatgttttcttggacgatttaatgatattcatgttcctgtgagattagaaagtgtgaaatttgccagtcattgtttaatgaatcacccagatttagcgaaggatctcacagaatatttaaaggttagatcacatgatccagaagaagctattcgtcatgatgtcattgttactataataacagctgccaagagggacctggccttagtaaatgatcagctgcttggctttgtaagggaaagaacactggataaacggtggcgagtaagaaaagaagctatgatgggtctggctcagctttataagaaatactgtcttcatggtgaagcaggaaaggaagctgcagagaaagtcagctggataaaggacaaacttctgcatatttattatcagaacagcattgacgacaaactgttggtagagaaaatctttgctcagtatcttgtcccccacaacctggaaacagaagagagaatgaaatgcttatattacttatatgctagtttggatccaaatgctgtaaaagctctcaacgaaatgtggaagtgtcagaacatgcttcggagccatgtacgcgaactattggatttgcacaagcagcctacatcagaggctaactgttctgccatgtttggaaaactgatgaccatagcaaagaatttgcctgaccccgggaaagcacaagattttgtgaagaaatttaaccaggttctcggcgatgatgagaaacttcggtctcagttggagttattaattagcccaacctgttcttgcaaacaagcagatatttgtgtgagagaaatagcccggaaacttgcaaatcctaagcaaccaacaaatccttttctagagatggtcaaatttctgttggaaagaatcgcacctgtgcacattgattcagaagccataagtgcactagtgaaattgatgaataagtcaatagaggggacagcagatgatgaagaggagggtgtaagtccagatacagctatccgttcaggacttgaacttcttaaggttctgtcttttacacatcctacctcgttccactctgcagagacatatgagtccttgttacagtgcctaagaatggaggatgacaaggtagcagaagctgctattcaaatttttagaaatacaggtcacaaaatagaaacagaccttccccagatacgatcgaccttaattcccattttacatcaaaaagcaaagaggggtactccacaccaagcaaaacaggctgtgcactgtatacacgccatattcacaaataaagaagtccagcttgcacagatttttgagccactcagtaggagtctgaatgctgatgtgccagaacaacttataactccattagtttcattgggccacatttctatgttagcaccagatcagtttgcttccccaatgaaatctgtagtagcaaattttattgtgaaagatctgctaatgaatgacaggtcaacaggtgaaaagaatggaaaactgtggtctccagatgaagaggtttcccctgaagtactagcaaaggtacaggcaattaaacttctggtaaggtggctgttgggtatgaaaaacaaccagtctaaatctgccaattcaacccttcggttattatcagcgatgttggttagtgagggtgacctgacagagcaaaagaggatcagtaaatctgatatgtctcgcttgcgattagctgctggtagtgccataatgaagcttgctcaggaaccttgttaccatgaaattattaccccagaacagtttcagctctgtgcacttgttattaatgatgagtgttaccaagtaaggcagatatttgctcagaagctgcataaggcacttgtgaagttactgctcccattggagtatatggcgatctttgccttgtgtgccaaagatcctgtgaaggagagaagagcacacgcacgacaatgtttactgaaaaatatcagtatacgcagggaatacattaagcagaatcctatggctactgagaaattattatcactgttgcctgaatatgtagttccatacatgattcacctgctagcccatgatccagattttacaagatcacaagatgttgatcagcttcgtgatatcaaagagtgcctatggttcatgcttgaagttttaatgacaaagaatgaaaacaatagccatgcctttatgaagaagatggcagagaacatcaagttaaccagagatgcccagtctccagatgaatccaagacaaatgaaaaactgtatacagtatgtgatgtggctctctgtgttataaatagtaaaagtgctttgtgcaatgcagattcaccaaaggacccagtcctcccaatgaaattttttacacaacctgaaaaggacttctgtaacgataagagttatatttcagaagagacaagagtacttctgttaacaggaaagccaaagcctgctggagtactaggtgcagtaaataagcctttatcagcaacgggaaggaaaccctatgttagaagcactggcactgagactggaagcaatattaatgtaaattcagagctgaacccttcaaccggaaatcgatcaagggaacagagttcagaggcagcagaaactggagttagtgaaaatgaagagaaccctgtgaggattatttcagtcacacctgtaaagaatattgacccagtaaagaataaggaaattaattctgatcaggctacccagggcaacatcagcagtgaccgaggaaagaaaagaacagtaacagcagctggtgcagagaatatccaacaaaaaacagatgagaaagtagatgaatcgggacctcccgccccttccaaacccaggagaggacgtcgacccaagtctgaatctcagggcaatgctaccaaaaatgatgatctaaataaacctattaacaagggaaggaagagagctgcagtgggtcaggagagccctgggggtttggaagcaggtaatgccaaagcacccaaactgcaagatttagccaaaaaggcagcaccagcagaaagacaaattgacttacaaaggtaa

SEQ ID NO: 8338 - DNA, 2022 bp, synthetic construct
  misc_feature 1..2022: note = Synthetic polypeptide
  source 1..2022: mol_type = other DNA
agcctccaagatagctctgaatgatccttatttccttgtatttactcccttgtatagtcccctgcaacactgaacggggctgtcctgagtaacggaacaggctgtggtagaagtgacaatgtatgcttttcaaggttaggtcgtaaaagactgccacttcatatttgctctcttggatcttgcaccaggggaaaaccaactgccttttcacttgagctgtctagaaaggcccatgtagtgtggaactgaagcctttcaacaacagcaagtgtcaacttagaaccgtaagaatgagttaccttcaaaacacaccctccacgcccagtcaagccttcagataactgcagccttgaccagatggtagtgaaaacctttatggatatggatcaggactcagaagatgaaaaacagcagtatctcccactagccttgcatcttgcatctgaattcttcctcaggaaccccaataaagatgtgcgtctccttgtagcatgttgtttggctgatatctttcgtatctatgccccagaagctccatatacttcccatgataaacttaaggacatatttttgtttattaccagacaattaaaaggtttggaggatacaaagagtccacagtttaatagatacttttatttattagagaatttagcttgggttaaatcatataacatctgctttgaattggaagattgcaatgaaatttttattcagctttttagaactctcttctcagtgatcaacaatagccacaataagaaggtacaaatgcacatgctagatttgatgagttctatcatcatggaaggtgatggagttactcaagaattattggactccattcttattaacctcattcctgcacataagaacttaaataaacagtcctttgaccttgcaaaagtgctattgaaaagaacagtccagactattgaggcatgcattgctaattttttcaatcaagtcctggtgctgggaagatcatcagtaagtgatttgtcagaacatgtatttgatctgattcaggaactttttgctatagatcctcatttattattatccgtcatgccacagcttgaattcaaactaaagagcaatgatggagaagagcgattagctgttgttcgacttctagctaaattgtttggctccaaagattctgatttggcaacacagaatcgtcctctttggcaatgttttcttggacgatttaatgatattcatgttcctgtgagattagaaagtgtgaaatttgccagtcattgtttaatgaatcacccagatttagcgaaggatctcacagaatatttaaaggttagatcacatgatccagaagaagctattcgtcatgatgtcattgttactataataacagctgccaagagggacctggccttagtaaatgatcagctgcttggctttgtaagggaaagaacactggataaacggtggcgagtaagaaaagaagctatgatgggtctggctcagctttataagaaatactgtcttcatggtgaagcaggaaaggaagctgcagagaaagtcagctggataaaggacaaacttctgcatatttattatcagaacagcattgacgacaaactgttggtagagaaaatctttgctcagtatcttgtcccccacaacctggaaacagaagagagaatgaaatgcttatattacttatatgctagtttggatccaaatgctgtaaaagctctcaacgaaatgtggaagtgtcagaacatgcttcggagccatgtacgcgaactattggatttgcacaagcagcctacatcagaggctaactgttctgccatgtttggaaaactgatgaccatagcaaagaatttgcctgaccccgggaaagcacaagattttgtgaagaaatttaaccaggttctcggcgatgatgagaaacttcggtctcagttggagttattaattagcccaacctgttcttgcaaacaagcagatatttgtgtggttagtaaatcatacttcacactttttctctag

SEQ ID NO: 8339 - DNA, 636 bp, synthetic construct
  misc_feature 1..636: note = Synthetic polypeptide
  source 1..636: mol_type = other DNA
ctgggtgcggtggctcttacctacaatcccagcaccttgagaggccagaggaggatcgcttgaggccagaagtttgagatcgcctgggcaacaaagcacaacctcatctctgcaaaaaaatttaaaagttagccaggtgtggtggcacatgcctgtagtctcagctgcttgggaggctaaggttgcaacaaggacagtgtcagagcaggctgtaaaaaatgtggctaccctggtcacctgacttttgaatgccgcaattttctccgagtagaccctaaaagggacatagttttggatgtcagcagtacaagtagtgaagatagcgatgaagagaatgaagaactgaataaattgcaggcattacaggaaaaaagaataaatgaagaagaggaaaagaagaaagaaaaaagcaaagaaaaaatcaaattgaaaaaaaaaaggaaaaggtcttactcatccagttccactgaagaggacacttcaaaacaaaagaaacaaaaatatcagaagaaagaaaagaaaaaagaaaaaaagagtaaatcaaaaaaagggaaacatcacaaaaaggaaaaaaagaagagaaaaaaggaaaagcattcttctacacctaatagttctgaattctccagaaagtaa

SEQ ID NO: 8340 - DNA, 1062 bp, synthetic construct
  misc_feature 1..1062: note = Synthetic polypeptide
  source 1..1062: mol_type = other DNA
gtggaaacaacccaaatatgtatcaactggtaaatggataaacaaagcacactgcatgctccacaatggatgaaacttagaaccttaaaaacatcatgctgagtgaaagaagccagacacaaaaggccatgtatcatgggattccattcatgtcaaatgtccaaaacagatgtgaaaagctggcttgtgatgtttggatttcagcttagcaacatcattcctggcttcccgagagccaaaatgtatttcgtgcctcctccctatgaattgtcagagagtcaagcaagtgagaatggacagctcattacaggtgtccaacagacaacagagagacataaccaggccttcatggctctggaaggacaggtcattactaaaaagctccacgccagcatccgagagaaagcaggtcactggtttgccaccaccacgcccatcattggcaaaggcatcatgtttgccatcaaagaagggcgggtgaccacgggcgtgtccagcatcgccagcgaagatagccgcaaggtggcatctgtgctgaacaacgcctactacctggacaagatgcactacagcatcgagggcaaggacacccactactttgtgaagattggctcagccgatggcgacctggtcacactaggcaccaccatcggccgcaaggtgctagagagcggggtgaacgtgaccgtgtcccagcccacgctgctggtcaacggcaggactcgaaggttcacgaacattgagttccagtactccacgctgctgctcagcatccgctatggcctcacccccgacaccctggacgaagagaaggcccgcgtcctggaccaggcgagacagagggccctgggcacggcctgggccaaggagcagcagaaagccagggacgggagagaggggagccgcctgtggactgagggcgagaagcagcagcttctgagcaccgggcgcgtgcaagggtacgagggatattacgtgcttcccgtggagcaatacccagagcttgcagacagtagcagcaacatccagtttttaagacagaatgagatgggaaagaggtaa

SEQ ID NO: 8341 - DNA, 74 bp, synthetic construct; identical to SEQ ID NO: 7010
  misc_feature 1..74: note = Synthetic polypeptide
  source 1..74: mol_type = other DNA

SEQ ID NO: 8342 - DNA, 1023 bp, synthetic construct; identical to SEQ ID NO: 611
  misc_feature 1..1023: note = Synthetic polypeptide
  source 1..1023: mol_type = other DNA

SEQ ID NO: 8343 - DNA, 588 bp, synthetic construct; identical to SEQ ID NO: 7495
  misc_feature 1..588: note = Synthetic polypeptide
  source 1..588: mol_type = other DNA

SEQ ID NO: 8344 - DNA, 4725 bp, synthetic construct
  misc_feature 1..4725: note = Synthetic polypeptide
  source 1..4725: mol_type = other DNA
acagctcagtggcaaaatgcagacttgaacaacattgcccgagtttgaattcagctccagagcttaccagctgtgtgatactggacacagtatttaacccttctgtgcctgagtttcacatctgaaaaaggagatgataaaaataattacagaatgaaaggagataatacacatgaggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtga

SEQ ID NO: 8345 - DNA, 4530 bp, synthetic construct
  misc_feature 1..4530: note = Synthetic polypeptide
  source 1..4530: mol_type = other DNA
acagctcagtggcaaaatgcagacttgaacaacattgcccgagtttgaattcagctccagagcttaccagctgtgtgatactggacacagtatttaacccttctgtgcctgagtttcacatctgaaaaaggagatgataaaaataattacagaatgaaaggagataatacacatgaggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagggtgatcgtcttggacaaaggagaaatccaggagtacggcgccccatcggacctcctgcagcagagaggtcttttctacagcatggccaaagacgccggcttggtgtga

SEQ ID NO: 8346 - DNA, 4557 bp, synthetic construct
  misc_feature 1..4557: note = Synthetic polypeptide
  source 1..4557: mol_type = other DNA
acagctcagtggcaaaatgcagacttgaacaacattgcccgagtttgaattcagctccagagcttaccagctgtgtgatactggacacagtatttaacccttctgtgcctgagtttcacatctgaaaaaggagatgataaaaataattacagaatgaaaggagataatacacatgaggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtga

SEQ ID NO: 8347 - DNA, 4380 bp, synthetic construct
  misc_feature 1..4380: note = Synthetic polypeptide
  source 1..4380: mol_type = other DNA
acagctcagtggcaaaatgcagacttgaacaacattgcccgagtttgaattcagctccagagcttaccagctgtgtgatactggacacagtatttaacccttctgtgcctgagtttcacatctgaaaaaggagatgataaaaataattacagaatgaaaggagataatacacatgaggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtga

SEQ ID NO: 8348 - DNA, 4548 bp, synthetic construct
  misc_feature 1..4548: note = Synthetic polypeptide
  source 1..4548: mol_type = other DNA
acagctcagtggcaaaatgcagacttgaacaacattgcccgagtttgaattcagctccagagcttaccagctgtgtgatactggacacagtatttaacccttctgtgcctgagtttcacatctgaaaaaggagatgataaaaataattacagaatgaaaggagataatacacatgaggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtga

SEQ ID NO: 8349 - DNA, 4755 bp, synthetic construct
  misc_feature 1..4755: note = Synthetic polypeptide
  source 1..4755: mol_type = other DNA
acagctcagtggcaaaatgcagacttgaacaacattgcccgagtttgaattcagctccagagcttaccagctgtgtgatactggacacagtatttaacccttctgtgcctgagtttcacatctgaaaaaggagatgataaaaataattacagaatgaaaggagataatacacatgaggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggcagcacagtgatggacgaggaggaagcaggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtga

SEQ ID NO: 8350 - DNA, 1790 bp, synthetic construct
  misc_feature 1..1790: note = Synthetic polypeptide
  source 1..1790: mol_type = other DNA
cccaaaatcctccccgcagaccctactgctggtgacaaatctctcactggcctatagcagtgtacaactctgagcgttgtgacataaagtacatcgaggtgacctccgccagatcaaggtgccacgatggcccccagcactgctccagcccctctgtcaccccgcccttcggctcccttcgcagtggtggcctcctcctttccagagacgtcccccgagagacacgaagcagcagtgagagcctcatcttctctgggaaccagggcagggggcaccagcgccctctgcccccctcagagggtctctcccctcgacccccaaattcccccagcatctcaatcccttgcatggggagcaaggcctcgagcccccatggtttgggctccccgctggtggcttctccaagactggagaagcggctgggaggcctggccccacagcggggcagcaggatctctgtgctgtcagccagcccagtgtctgatgtcagctatatgtttggaagcagccagtccctcctgcactccagcaactccagccatcagtcatcttccagatccttggaaagtccagccaactcttcctccagcctccacagccttggctcagtgtccctgtgtacaagacccagtgacttccaggctcccagaaaccccaccctaaccatgggccaacccagaacaccccactctccaccactggccaaagaacatgccagcagctgccccccatccatcaccaactccatggtggacatacccattgtgctgatcaacggctgcccagaaccagggtcttctccaccccagcggaccccaggacaccagaactccgttcaacctggagctgcttctcccagcaacccctgtccagccaccaggagcaacagccagaccctgtcagatgccccctttaccacatgcccagagggtcccgccagggacatgcagcccaccatgaagttcgtgatggacacatctaaatactggtttaagccaaacatcacccgagagcaagcaatcgagctgctgaggaaggaggagccaggggcttttgtcataagggacagctcttcataccgaggctccttcggcctggccctgaaggtgcaggaggttcccgcgtctgctcagagtcgaccaggtgaggacagcaatgacctcatccgacacttcctcatcgagtcgtctgccaaaggagtgcatctcaaaggagcagatgaggagccctactttgggagcctctctgccttcgtgtgccagcattccatcatggccctggccctgccctgcaaactcaccatcccacagagagaactgggaggtgcagatggggcctcggactctacagacagcccagcctcctgccagaagaaatctgcgggctgccacaccctgtacctgagctcagtgagcgtggagaccctgactggagccctggccgtgcagaaagccatctccaccacctttgagagggacatcctccccacgcccaccgtggtccacttcaaagtcacagagcagggcatcactctgactgatgtccagaggaaggtgtttttccggcgccattacccactcaccaccctccgcttctgtggtatggaccctgagcaacggaagtggcagaagtactgcaaaccctcctggatctttgggtttgtggccaagagccagacagagcctcaggagaacgtatgccacctctttgcggagtatgacatggtccagccagcctcgcaggtcatcggcctggtgactgctctgctgcaggacgcagaaaggatgtag

SEQ ID NO: 8351 - DNA, 913 bp, synthetic construct
  misc_feature 1..913: note = Synthetic polypeptide
  source 1..913: mol_type = other DNA
cagcccttgttgagtctttatggcttatctcacgtcatgagaatttttgcacgcatgctgctctgtgacacccctgtaggagggaagaaggagcccacttctcaagagccaggcaggaaggggagaactggaggtcaggaacatcatcctttggccattagctagagaacctagttccttcaagagaggatgcatggagaccaggtcatagcaaagggccggaagatctgcctgaatctttcagatatttcaacaactcatgatgggaaactcaccatcaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtga

SEQ ID NO: 8352 - DNA, 718 bp, synthetic construct
  misc_feature 1..718: note = Synthetic polypeptide
  source 1..718: mol_type = other DNA
cagcccttgttgagtctttatggcttatctcacgtcatgagaatttttgcacgcatgctgctctgtgacacccctgtaggagggaagaaggagcccacttctcaagagccaggcaggaaggggagaactggaggtcaggaacatcatcctttggccattagctagagaacctagttccttcaagagaggatgcatggagaccaggtcatagcaaagggccggaagatctgcctgaatctttcagatatttcaacaactcatgatgggaaactcaccatcaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagggtgatcgtcttggacaaaggagaaatccaggagtacggcgccccatcggacctcctgcagcagagaggtcttttctacagcatggccaaagacgccggcttggtgtga

SEQ ID NO: 8353 - DNA, 852 bp, synthetic construct; identical to SEQ ID NO: 753
  misc_feature 1..852: note = Synthetic polypeptide
  source 1..852: mol_type = other DNA

SEQ ID NO: 8354 - DNA, 2405 bp, synthetic construct
  misc_feature 1..2405: note = Synthetic polypeptide
  source 1..2405: mol_type = other DNA
ggccaggcgcagtggctcacacctgtaatcccagcactttgggaggccgaggcaggtcaggattttactggaatggcgtggctgtcttccccaagcctccccaagatggggtgtaccccaacatgagtgagcctgtcaccccagccaacatcaacctctatgccgaggccctggtggccaacgtgaagcagagggccgcctggttccggacaccgcacgtcctctggccctggggatgtgacaagcagttcttcaatgcctcggtgcagtttgccaacatggacccgctgctggaccacatcaacagccatgctgccgagctcggtgtctcggtgcagtatgccacgctgggcgactacttccgtgccctgcacgctctcaatgtcacctggcgtgtccgcgaccaccacgacttcctgccctattccacagaaccattccaggcctggacgggcttctacacgtcccgcagctcactgaaggggctggcccggcgagccagcgccttgttgtatgccggggagtccatgttcacacgctacctgtggccggccccccgtgggcatctggaccccacctgggccctgcagcagctccagcagcttcgctgggccgtctccgaggtccagcaccatgatgccatcactgggactgagtcccccaaggtgagagacatgtacgcaacgcacctggcctcggggatgctgggcatgcgcaagctgatggcctccatcgtcctagatgagctccagccccaggcacccatggcggccagctccgatgcaggacctgcaggacattttgcctcggtctacaacccgctggcctggacggtcaccaccatcgtcaccctgactgttggtttccctggagtccgcgtcacagatgaggcgggccacccagtgccctcgcagatccagaactcaacagagaccccatctgcgtatgacctgcttattctgaccacaatcccaggcctcagttaccggcactacaacatcagacccactgcaggggcccaagagggcacccaggagccggctgccactgtggcgagcacccttcaatttggccgcaggctgaggagacgcaccagccatgcgggcaggtacttggtgcctgtggcaaacgactgctacattgtgctgctcgaccaggataccaacctgatgcacagcatctgggagagacagagtaaccgaacggtgcgcgtgacccaggaattcctggagtaccacgtcaacggggatgtgaaacagggccccatttccgataactacctgttcacaccgggcaaggccgcggtgcctgcgtgggaagctgtggaaatggagattgtggcgggacagcttgtgactgagatccggcagtacttctacaggaacatgacagcacagaattacacgtatgcaatccgctcccggctcacccatgtgccgcagggccatgacggggagctgctctgccaccggatagagcaggagtaccaagccggccccctggagctgaaccgtgaggctgtcctgaggaccagcaccaacctaaacagccagcaggtcatctactcagacaacaacggctaccagatgcagcggaggccctacgtttcctatgtgaacaacagcatcgcccggaattactaccccatggttcagtcggccttcatggaggatggcaaaagcaggcttgtgttgctgtcggagcgggcacatggcatctccagccaagggaatgggcaggtggaggtcatgctccaccggcggctgtggaacaacttcgactgggacctgggctacaacctcacgctgaacgacacctcagtcgtccacccagtgctctggcttctgctgggatcctggtccctcaccactgccctgcgccagaggagcgcactggcgctgcagcacaggcccgtggtgctgttcggagacctcgctgggactgcgccgaagctcccaggaccccagcagcaagaggccgtgacgctgcccccgaatcttcacctgcagatcctgagcatccctggctggcgctacagctccaaccacacggagcactctcagaatctccggaaaggccatcgaggggaagcccaggctgacctccgccgtgtcctgctgcggctctaccacctatatgaagtgggcgaggacccagtcctgtctcagccagtgacagtgaatctggaggctgtgctgcaggcgctggggtccgtggtggcagtggaggagcgctcgctcacagggacctgggatttgagcatgctgcaccgctggagctggaggacggggcctggccgccacagaggtgacaccacctctccctcgaggccaccaggaggccccatcatcaccgtccacccaaaggaaatccggacgttctttattcactttcaacagcagtga

SEQ ID NO: 8355 - DNA, 2252 bp, synthetic construct
  misc_feature 1..2252: note = Synthetic polypeptide
  source 1..2252: mol_type = other DNA
ggccaggcgcagtggctcacacctgtaatcccagcactttgggaggccgaggcaggtcaggattttactggaatggcgtggctgtcttccccaagcctccccaagatggggtgtaccccaacatgagtgagcctgtcaccccagccaacatcaacctctatgccgagctcggtgtctcggtgcagtatgccacgctgggcgactacttccgtgccctgcacgctctcaatgtcacctggcgtgtccgcgaccaccacgacttcctgccctattccacagaaccattccaggcctggacgggcttctacacgtcccgcagctcactgaaggggctggcccggcgagccagcgccttgttgtatgccggggagtccatgttcacacgctacctgtggccggccccccgtgggcatctggaccccacctgggccctgcagcagctccagcagcttcgctgggccgtctccgaggtccagcaccatgatgccatcactgggactgagtcccccaaggtgagagacatgtacgcaacgcacctggcctcggggatgctgggcatgcgcaagctgatggcctccatcgtcctagatgagctccagccccaggcacccatggcggccagctccgatgcaggacctgcaggacattttgcctcggtctacaacccgctggcctggacggtcaccaccatcgtcaccctgactgttggtttccctggagtccgcgtcacagatgaggcgggccacccagtgccctcgcagatccagaactcaacagagaccccatctgcgtatgacctgcttattctgaccacaatcccaggcctcagttaccggcactacaacatcagacccactgcaggggcccaagagggcacccaggagccggctgccactgtggcgagcacccttcaatttggccgcaggctgaggagacgcaccagccatgcgggcaggtacttggtgcctgtggcaaacgactgctacattgtgctgctcgaccaggataccaacctgatgcacagcatctgggagagacagagtaaccgaacggtgcgcgtgacccaggaattcctggagtaccacgtcaacggggatgtgaaacagggccccatttccgataactacctgttcacaccgggcaaggccgcggtgcctgcgtgggaagctgtggaaatggagattgtggcgggacagcttgtgactgagatccggcagtacttctacaggaacatgacagcacagaattacacgtatgcaatccgctcccggctcacccatgtgccgcagggccatgacggggagctgctctgccaccggatagagcaggagtaccaagccggccccctggagctgaaccgtgaggctgtcctgaggaccagcaccaacctaaacagccagcaggtcatctactcagacaacaacggctaccagatgcagcggaggccctacgtttcctatgtgaacaacagcatcgcccggaattactaccccatggttcagtcggccttcatggaggatggcaaaagcaggcttgtgttgctgtcggagcgggcacatggcatctccagccaagggaatgggcaggtggaggtcatgctccaccggcggctgtggaacaacttcgactgggacctgggctacaacctcacgctgaacgacacctcagtcgtccacccagtgctctggcttctgctgggatcctggtccctcaccactgccctgcgccagaggagcgcactggcgctgcagcacaggcccgtggtgctgttcggagacctcgctgggactgcgccgaagctcccaggaccccagcagcaagaggccgtgacgctgcccccgaatcttcacctgcagatcctgagcatccctggctggcgctacagctccaaccacacggagcactctcagaatctccggaaaggccatcgaggggaagcccaggctgacctccgccgtgtcctgctgcggctctaccacctatatgaagtgggcgaggacccagtcctgtctcagccagtgacagtgaatctggaggctgtgctgcaggcgctggggtccgtggtggcagtggaggagcgctcgctcacagggacctgggatttgagcatgctgcaccgctggagctggaggacggggcctggccgccacagaggtgacaccacctctccctcgaggccaccaggaggccccatcatcaccgtccacccaaaggaaatccggacgttctttattcactttcaacagcagtga

SEQ ID NO: 8356 - DNA, 2240 bp, synthetic construct
  misc_feature 1..2240: note = Synthetic polypeptide
  source 1..2240: mol_type = other DNA
ggccaggcgcagtggctcacacctgtaatcccagcactttgggaggccgaggcaggtcaggattttactggaatggcgtggctgtcttccccaagcctccccaagatggggtgtaccccaacatgagtgagcctgtcaccccagccaacatcaacctctatgccgaggccctggtggccaacgtgaagcagagggccgcctggttccggacaccgcacgtcctctggccctggggatgtgacaagcagttcttcaatgcctcggtgcagtttgccaacatggacccgctgctggaccacatcaacagccatgctgccgagctcggtgtctcggtgcagtatgccacgctgggcgactacttccgtgccctgcacgctctcaatgtcacctggcgtgtccgcgaccaccacgacttcctgccctattccacagaaccattccaggcctggacgggcttctacacgtcccgcagctcactgaaggggctggcccggcgagccagcgccttgttgtatgccggggagtccatgttcacacgctacctgtggccggccccccgtgggcatctggaccccacctgggccctgcagcagctccagcagcttcgctgggccgtctccgaggtccagcaccatgatgccatcactgggactgagtcccccaaggtgagagacatgtacgcaacgcacctggcctcggggatgctgggcatgcgcaagctgatggcctccatcgtcctagatgagctccagccccaggcacccatggcggccagctccgatgcaggacctgcaggacattttgcctcggtctacaacccgctggcctggacggtcaccaccatcgtcaccctgactgttggtttccctggagtccgcgtcacagatgaggcgggccacccagtgccctcgcagatccagaactcaacagagaccccatctgcgtatgacctgcttattctgaccacaatcccaggcctcagttaccggcactacaacatcagacccactgcaggggcccaagagggcacccaggagccggctgccactgtggcgagcacccttcaatttggccgcaggctgaggagacgcaccagccatgcgggcaggtacttggtgcctgtggcaaacgactgctacattgtgctgctcgaccaggataccaacctgatgcacagcatctgggagagacagagtaaccgaacggtgcgcgtgacccaggaattcctggagtaccacgtcaacggggatgtgaaacagggccccatttccgataactacctgttcacaccgggcaaggccgcggtgcctgcgtgggaagctgtggaaatggagattgtggcgggacagcttgtgactgagatccggcagtacttctacaggaacatgacagcacagaattacacgtatgcaatccgctcccggctcacccatgtgccgcagggccatgacggggagctgctctgccaccggatagagcaggagtaccaagccggccccctggagctgaaccgtgaggctgtcctgaggaccagcaccaacctaaacagccagcaggtcatctactcagacaacaacggctaccagatgcagcggaggccctacgtttcctatgtgaacaacagcatcgcccggaattactaccccatggttcagtcggccttcatggaggatggcaaaagcaggcttgtgttgctgtcggagcgggcacatggcatctccagccaagggaatgggcaggtggaggtcatgctccaccggcggctgtggaacaacttcgactgggacctgggctacaacctcacgctgaacgacacctcagtcgtccacccagtgctctggcttctgctgggatcctggtccctcaccactgccctgcgccagaggagcgcactggcgctgcagcacaggcccgtggtgctgttcggagacctcgctgggactgcgccgaagctcccaggaccccagcagcaagaggccgtgacgctgcccccgaatcttcacctgcagatcctgagcatccctggctggcgctacagctccaaccacacggagcactctcagaatctccggaaaggccatcgaggggaagcccaggctgacctccgccgtgtcctgctgcggctctaccacctatatgaagtgggcgaggacccagtcctgtctcagccagtgacagtgaatctggaggtgaacttccccacccccatccagaccataagccagggaagcaaaccctag

SEQ ID NO: 8357 - DNA, 2148 bp, synthetic construct
  misc_feature 1..2148: note = Synthetic polypeptide
  source 1..2148: mol_type = other DNA
ggccaggcacagtggctcacgcctgtaatccctgcactttgggaggctgaggctggcggatcacctgagtacctggttgactgtgatgaagtgatcttcatgaaagagggctgtattacggaaagaggcacccatgaggaactgatgaatttaaatggtgactatgctaccatttttaataacctgttgctgggagagacaccgccagttgagatcaattcaaaaaaggaaaccagtggttcacagaagaagtcacaagacaagggtcctaaaacaggatcagtaaagaaggaaaaagcagtaaagccagaggaagggcagcttgtgcagctggaagagaaagggcagggttcagtgccctggtcagtatatggtgtctacatccaggctgctgggggccccttggcattcctggttattatggcccttttcatgctgaatgtaggcagcaccgccttcagcacctggtggttgagttactggatcaagcaaggaagcgggaacaccactgtgactcgagggaacgagacctcggtgagtgacagcatgaaggacaatcctcatatgcagtactatgccagcatctacgccctctccatggcagtcatgctgatcctgaaagccattcgaggagttgtctttgtcaagggcacgctgcgagcttcctcccggctgcatgacgagcttttccgaaggatccttcgaagccctatgaagttttttgacacgacccccacagggaggattctcaacaggttttccaaagacatggatgaagttgacgtgcggctgccgttccaggccgagatgttcatccagaacgttatcctggtgttcttctgtgtgggaatgatcgcaggagtcttcccgtggttccttgtggcagtggggccccttgtcatcctcttttcagtcctgcacattgtctccagggtcctgattcgggagctgaagcgtctggacaatatcacgcagtcacctttcctctcccacatcacgtccagcatacagggccttgccaccatccacgcctacaataaagggcaggagtttctgcacagataccaggagctgctggatgacaaccaagctcctttttttttgtttacgtgtgcgatgcggtggctggctgtgcggctggacctcatcagcatcgccctcatcaccaccacggggctgatgatcgttcttatgcacgggcagattcccccagcctatgcgggtctcgccatctcttatgctgtccagttaacggggctgttccagtttacggtcagactggcatctgagacagaagctcgattcacctcggtggagaggatcaatcactacattaagactctgtccttggaagcacctgccagaattaagaacaaggctccctcccctgactggccccaggagggagaggtgacctttgagaacgcagagatgaggtaccgagaaaacctccctctcgtcctaaagaaagtatccttcacgatcaaacctaaagagaagattggcattgtggggcggacaggatcagggaagtcctcgctggggatggccctcttccgtctggtggagttatctggaggctgcatcaagattgatggagtgagaatcagtgatattggccttgccgacctccgaagcaaactctctatcattcctcaagagccggtgctgttcagtggcactgtcagatcaaatttggaccccttcaaccagtacactgaagaccagatttgggatgccctggagaggacacacatgaaagaatgtattgctcagctacctctgaaacttgaatctgaagtgatggagaatggggataacttctcagtgggggaacggcagctcttgtgcatagctagagccctgctccgccactgtaagattctgattttagatgaagccacagctgccatggacacagagacagacttattgattcaagagaccatccgagaagcatttgcagactgtaccatgctgaccattgcccatcgcctgcacacggttctaggctccgataggattatggtgctggcccagggacaggtggtggagtttgacaccccatcggtccttctgtccaacgacagttcccgattctatgccatgtttgctgctgcagagaacaaggtcgctgtcaagggctga

SEQ ID NO: 8358 - DNA, 2019 bp, synthetic construct
  misc_feature 1..2019: note = Synthetic polypeptide
  source 1..2019: mol_type = other DNA
ggccaggcacagtggctcacgcctgtaatccctgcactttgggaggctgaggctggcggatcacctgagtacctggttgactgtgatgaagtgatcttcatgaaagagggctgtattacggaaagaggcacccatgaggaactgatgaatttaaatggtgactatgctaccatttttaataacctgttgctgggagagacaccgccagttgagatcaattcaaaaaaggaaaccagtggttcacagaagaagtcacaagacaagggtcctaaaacaggatcagtaaagaaggaaaaagcagtaaagccagaggaagggcagcttgtgcagctggaagagaaagggcagggttcagtgccctggtcagtatatggtgtctacatccaggctgctgggggccccttggcattcctggttattatggcccttttcatgctgaatgtaggcagcaccgccttcagcacctggtggttgagttactggatcaagcaaggaagcgggaacaccactgtgactcgagggaacgagacctcggtgagtgacagcatgaaggacaatcctcatatgcagtactatgccagcatctacgccctctccatggcagtcatgctgatcctgaaagccattcgaggagttgtctttgtcaagggcacgctgcgagcttcctcccggctgcatgacgagcttttccgaaggatccttcgaagccctatgaagttttttgacacgacccccacagggaggattctcaacaggttttccaaagacatggatgaagttgacgtgcggctgccgttccaggccgagatgttcatccagaacgttatcctggtgttcttctgtgtgggaatgatcgcaggagtcttcccgtggttccttgtggcagtggggccccttgtcatcctcttttcagtcctgcacattgtctccagataccaggagctgctggatgacaaccaagctcctttttttttgtttacgtgtgcgatgcggtggctggctgtgcggctggacctcatcagcatcgccctcatcaccaccacggggctgatgatcgttcttatgcacgggcagattcccccagcctatgcgggtctcgccatctcttatgctgtccagttaacggggctgttccagtttacggtcagactggcatctgagacagaagctcgattcacctcggtggagaggatcaatcactacattaagactctgtccttggaagcacctgccagaattaagaacaaggctccctcccctgactggccccaggagggagaggtgacctttgagaacgcagagatgaggtaccgagaaaacctccctctcgtcctaaagaaagtatccttcacgatcaaacctaaagagaagattggcattgtggggcggacaggatcagggaagtcctcgctggggatggccctcttccgtctggtggagttatctggaggctgcatcaagattgatggagtgagaatcagtgatattggccttgccgacctccgaagcaaactctctatcattcctcaagagccggtgctgttcagtggcactgtcagatcaaatttggaccccttcaaccagtacactgaagaccagatttgggatgccctggagaggacacacatgaaagaatgtattgctcagctacctctgaaacttgaatctgaagtgatggagaatggggataacttctcagtgggggaacggcagctcttgtgcatagctagagccctgctccgccactgtaagattctgattttagatgaagccacagctgccatggacacagagacagacttattgattcaagagaccatccgagaagcatttgcagactgtaccatgctgaccattgcccatcgcctgcacacggttctaggctccgataggattatggtgctggcccagggacaggtggtggagtttgacaccccatcggtccttctgtccaacgacagttcccgattctatgccatgtttgctgctgcagagaacaaggtcgctgtcaagggctga

SEQ ID NO: 8359 - DNA, 544 bp, synthetic construct
  misc_feature 1..544: note = Synthetic polypeptide
  source 1..544: mol_type = other DNA
gaaaggtagcatggtgggatggaatgagcacaaggtgcccagagttagaaagtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcagtatcctttttatgatatgggccctcacattttccaaacctgtccatctgctaactattttgactgcagagccatgtccattggagcccgttcccaatcagctcgtacttacttggagagacatatgtctgaatttatggagtgtaatttaa

SEQ ID NO: 8360 - DNA, 841 bp, synthetic construct
  misc_feature 1..841: note = Synthetic polypeptide
  source 1..841: mol_type = other DNA
gaaaggtagcatggtgggatggaatgagcacaaggtgcccagagttagaaagtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaa

SEQ ID NO: 8361 - DNA, 2850 bp, synthetic construct; identical to SEQ ID NO: 512
  misc_feature 1..2850: note = Synthetic polypeptide
  source 1..2850: mol_type = other DNA

SEQ ID NO: 8362 - DNA, 477 bp, synthetic construct; identical to SEQ ID NO: 513
  misc_feature 1..477: note = Synthetic polypeptide
  source 1..477: mol_type = other DNA

SEQ ID NO: 8363 - DNA, 1795 bp, synthetic construct; identical to SEQ ID NO: 879
  misc_feature 1..1795: note = Synthetic polypeptide
  source 1..1795: mol_type = other DNA

SEQ ID NO: 8364 - DNA, 1171 bp, synthetic construct; identical to SEQ ID NO: 880
  misc_feature 1..1171: note = Synthetic polypeptide
  source 1..1171: mol_type = other DNA

SEQ ID NO: 8365 - DNA, 2471 bp, synthetic construct; identical to SEQ ID NO: 576
  misc_feature 1..2471: note = Synthetic polypeptide
  source 1..2471: mol_type = other DNA

SEQ ID NO: 8366 - DNA, 657 bp, synthetic construct
  misc_feature 1..657: note = Synthetic polypeptide
  source 1..657: mol_type = other DNA
ggctgggcacagtggctcaagcctgcaatcccagcactttgggaggccgtggcgggtggatcacgaggtcaggagatcgagaccatcctggctaacacgtatgccaccacgggctgttccctgaccctgcaccatacggagaaaccagaacatgaagacatatgtgaataccgtccctactcctgcccatgtcctggtgcttcctgcaagtggcaggggtccctggaagctgtgatgtcccatctcatgcacgcccacaagagcattaccacccttcagggagaagacatcgtctttctagctacagacattaacttgccaggggctgtcgactgggtgatgatgcagtcatgttttggccatcacttcatgctggtgctggagaaacaagagaagtacgaaggccaccagcagttttttgccatcgtcctgctcattggcacccgcaagcaagccgagaactttgcctacagactggagttgaatgggaaccggcggagattgacctgggaggccacgccccgttcgattcatgacggtgtggctgcggccatcatgaacagcgactgccttgttttcgacacagccatagcacatctttttgcagataatgggaaccttggaatcaatgttactatttctacatgttgtccatga

SEQ ID NO: 8367 - DNA, 310 bp, synthetic construct
  misc_feature 1..310: note = Synthetic polypeptide
  source 1..310: mol_type = other DNA
ggctgggcacagtggctcaagcctgcaatcccagcactttgggaggccgtggcgggtggatcacgaggtcaggagatcgagaccatcctggctaacacgtatgccaccacgggctgttccctgaccctgcaccatacggagaaaccagaacatgaagacatatgtgaataccgtccctactcctgcccatgtcctggtgcttcctgcaagtggcaggggtccctggaagctgtgatgtcccatctcatgcacgcccacaagagcattaccacccttcagggagaagacatcgtctttctagctacagaca

SEQ ID NO: 8368 - DNA, 1927 bp, synthetic construct
  misc_feature 1..1927: note = Synthetic polypeptide
  source 1..1927: mol_type = other DNA
tgaatacacttatccatacattataataacctgaagcttttaaaaaatattaatgtggatctacatgcaccaataagggaaagttataaaataaagtgggggaaagatgcagaacagcaggatcagtttttcctacctctgcccagcctcctggtacttcactgtgcccacagtgagtccatttctccgtcagcgggtggcattcctgggactcttcttcatatcctgtctccttttacttatgttaatcatagactttcgacattggagtgcttcattaccacgagataggcaatacgaaaggtatttggctcgagtaggggagcttgaagctactgacactgaagacccaaatctgaattatggacttgttgttgactgtggcagcagtggttcccggatttttgtttatttctggccaagacataatgggaacccccatgacttgctggacatcaaacagatgagagaccgcaacagccaaccagtggttaaaaaaatcaagccaggaatctctgcaatggcagacactccagaacatgccagtgattaccttcgtcctctgctgagctttgctgctgctcatgtgcctgtgaagaagcacaaggagacccctctttacatcctctgcacagcaggcatgaggcttctccctgagaggaagcagttggctatcttggctgacctagtgaaagatttaccactggagtttgacttcctcttttcacagtctcaagcagaagtgatctctgggaagcaggaaggggtttatgcatggattggaatcaactttgttttgggaagattcgaccacgaggatgaatcagatgctgaggctacccaggaattggcagcaggacggagaaggacagtagggatactggatatgggaggagcctctctccaaattgcttatgaagttcctacctcaacctctgtccttcctgcaaagcaggaagaagctgccaagatcctgctggctgagttcaacctgggctgtgatgtgcaacacactgaacacgtgtacagggtttatgtcacaacttttctgggtttcggaggcaactttgcccggcagcgctacgaagaccttgttctgaatgaaactcttaacaaaaacagattgcttggtcagaagacaggtctgagtcccgacaatccatttctggatccctgcctgccagtgggactcacagatgtggtggagaggaacagccaagtcttacatgtccgaggaagaggagactgggtgtcttgtggggcaatgctgagccccctgctggctcgctccaacaccagccaggcctcactcaatggcatatatcaatcgcctattgacttcaacaacagcgagttctacggcttctctgagtttttttattgtacagaggatgtgttgcgcattggtggccgctaccatgggccaacatttgccaaggctgctcaggattactgtggcatggcttggtcggtactaactcagagattcaagaatggcctcttttcatcacatgcagatgagcatcgactcaaatatcagtgttttaaatcggcttggatgtaccaagtcttacatgaaggattccactttccctatgactacccaaacctgcggacagcccagctggtgtatgaccgagaggttcagtggacgctgggagccattctatataaaacacgattcttaccactcagggatcttcggcaggaaggtgtccgacaagcccatggtagctggttccgtctctcctttgtatacaaccactatctcttctttgcctgtatcctggtggtgctactggccatcttcctataccttctgcggctacgccgaattcaccaccgacaaacacgagcctcagctccattggacttgctgtggcttgaagaggtggtgcccatgatgggagtacaggtggggccgtga

SEQ ID NO: 8369 - DNA, 466 bp, synthetic construct
  misc_feature 1..466: note = Synthetic polypeptide
  source 1..466: mol_type = other DNA
gagccaagatggccaaataggaacagctccggtctacagctcccagcatgagcgacgcagaagatgggtgatttctgcatttccatctgagtatgctgtctggctagtcctctgggttacgtggaatgtgtttgttatctgcttctatttggaggctggggacctctcaaaggaaacagaccttatcctgacttttaatatatcaatgcaccgatcttggtggatggagaatggaccaggatgtacggtgacgtcagtgacacctgccccagactgggccccagaagaccatcgctacatcacggtctcagggtgtttgctggagtaccagtacatagaagtggctcatagttccctccagattgtcctcgcagtaagtgttggcagccaaccgctccttctagtgcctctggggttgttttatttctgtgcgaactcagtgcacacaaatggaatctgtgggtaa

SEQ ID NO: 8370 - DNA, 526 bp, synthetic construct
  misc_feature 1..526: note = Synthetic polypeptide
  source 1..526: mol_type = other DNA
gagccaagatggccaaataggaacagctccggtctacagctcccagcatgagcgacgcagaagatgggtgatttctgcatttccatctgagtatgctgtctggctagtcctctgggttacgtggaatgtgtttgttatctgcttctatttggaggctggggacctctcaaaggaaacagaccttatcctgacttttaatatatcaatgcaccgatcttggtggatggagaatggaccaggatgtacggtgacgtcagtgacacctgccccagactgggccccagaagaccatcgctacatcacggtctcagggtgtttgctggagtaccagtacatagaagtggctcatagttccctccagattgtcctcgcactggcaggtttcatctacgcctgttatgttgtgaaatgtataactgaagaagaggacagctttgatttcataggtggctttgactcttatggctatcaagggcctcagaagacatctcatttacaactacagcctatgtacatgtcaaaataa

SEQ ID NO: 8371 - DNA, 319 bp, synthetic construct
  misc_feature 1..319: note = Synthetic polypeptide
  source 1..319: mol_type = other DNA
gagccaagatggccaaataggaacagctccggtctacagctcccagcatgagcgacgcagaagatgggtgatttctgcatttccatctgagtatgctgtctggctagtcctctgggttacgtggaatgtgtttgttatctgcttctatttggaggctggggacctctcaaagctggcaggtttcatctacgcctgttatgttgtgaaatgtataactgaagaagaggacagctttgatttcataggtggctttgactcttatggctatcaagggcctcagaagacatctcatttacaactacagcctatgtacatgtaa

SEQ ID NO: 8372 - DNA, 520 bp, synthetic construct
  misc_feature 1..520: note = Synthetic polypeptide
  source 1..520: mol_type = other DNA
gagccaagatggccaaataggaacagctccggtctacagctcccagcatgagcgacgcagaagatgggtgatttctgcatttccatctgagtatgctgtctggctagtcctctgggttacgtggaatgtgtttgttatctgcttctatttggaggctggggacctctcaaaggaaacagaccttatcctgacttttaatatatcaatgcaccgatcttggtggatggagaatggaccaggatgtacggtgacgtcagtgacacctgccccagactgggccccagaagaccatcgctacatcacggtctcagggtgtttgctggagtaccagtacatagaagtggctcatagttccctccagattgtcctcgcactggcaggtttcatctacgcctgttatgttgtgaaatgtataactgaagaagaggacagctttgatttcataggtggctttgactcttatggctatcaagggcctcagaagacatctcatttacaactacagcctatgtacatgtaa

SEQ ID NO: 8373 - DNA, 287 bp, synthetic construct; identical to SEQ ID NO: 7101
  misc_feature 1..287: note = Synthetic polypeptide
  source 1..287: mol_type = other DNA

SEQ ID NO: 8374 - DNA, 281 bp, synthetic construct; identical to SEQ ID NO: 7102
  misc_feature 1..281: note = Synthetic polypeptide
  source 1..281: mol_type = other DNA

SEQ ID NO: 8375 - DNA, 1453 bp, synthetic construct
  misc_feature 1..1453: note = Synthetic polypeptide
  source 1..1453: mol_type = other DNA
agttctggggccttgggtaggtcacctcatcaacctcagccttgctctcctcattggtaaaaagcggggaagagtttctaccttggattttgatttctccacccaggtgaactcctccctcacctccccgacggggcgaggctccatggctgccccctcgctgcacccgtccctggggcctggcatcggctccccgggacagctgcattctcccatcagcaccctgagctcccccatcaacggcatgggcccgcctttctcggtcatcagctcccccatgggcccccactccatgtcggtgcccaccacacccaccctgggcttcagcactggcagcccccagctcagctcacctatgaaccccgtcagcagcagcgaggacatcaagccccccctgggcctcaatggcgtcctcaaggtccccgcccacccctcaggaaacatggcttccttcaccaagcacatctgcgccatctgcggggaccgctcctcaggcaagcactatggagtgtacagctgcgaggggtgcaagggcttcttcaagcggacggtgcgcaaggacctgacctacacctgccgcgacaacaaggactgcctgattgacaagcggcagcggaaccggtgccagtactgccgctaccagaagtgcctggccatgggcatgaagcgggaagccgtgcaggaggagcggcagcgtggcaaggaccggaacgagaatgaggtggagtcgaccagcagcgccaacgaggacatgccggtggagaggatcctggaggctgagctggccgtggagcccaagaccgagacctacgtggaggcaaacatggggctgaaccccagctcgccgaacgaccctgtcaccaacatttgccaagcagccgacaaacagcttttcaccctggtggagtgggccaagcggatcccacacttctcagagctgcccctggacgaccaggtcatcctgctgcgggcaggctggaatgagctgctcatcgcctccttctcccaccgctccatcgccgtgaaggacgggatcctcctggccaccgggctgcacgtccaccggaacagcgcccacagcgcaggggtgggcgccatctttgacagggtgctgacggagcttgtgtccaagatgcgggacatgcagatggacaagacggagctgggctgcctgcgcgccatcgtcctctttaaccctgactccaaggggctctcgaacccggccgaggtggaggcgctgagggagaaggtctatgcgtccttggaggcctactgcaagcacaagtacccagagcagccgggaaggttcgctaagctcttgctccgcctgccggctctgcgctccatcgggctcaaatgcctggaacatctcttcttcttcaagctcatcggggacacacccattgacaccttccttatggagatgctggaggcgccgcaccaaatgacttag

SEQ ID NO: 8376 - DNA, 4599 bp, synthetic construct
  misc_feature 1..4599: note = Synthetic polypeptide
  source 1..4599: mol_type = other DNA
ctccccctccctccctccccctctccctctccctctccccacggtctccctctgcctctctttccacggtctccctctgatgccgagccgaagctggactgtactgccgccatctctgctcactgcaacctccctgcctgattctcctgcctcaacctgccgagtgcctgcaattgcaggcacgcgccgccacgcctgactggttttcgtatttttttggtggagacggggtttcgctgtgttggccaggcaggtctctagctcctaaccgggagtaatctgccagcctcagcctcccgaggtgccgggattgcagatggagtcttgttcactcagtgctcaatgttgcccaggctggagtgcagcggcgtgatcttggctcactacaacctccacctcccagccgcctgccttggcctcccaaagtgccgagattgcagcctctgcctggccgccaccccatctgggaagtgaggagcgtctctgcctggccgcccatcgtctgggatgtgaggagcccctctgcccggctgcccagtctgggaagtgaggagcgcctcttcccggccgccatcccgtctaggaagtgaggagcgtctctgcccggccgcccatcgtctgagatgtggggagcgcctctgccccgccaccccatctgggatgtgaggagcgcctctgcccggccgcgaccccgtctgggaggtgaggagcatctctgcccggccaccccgtctgagaagtgaggagcccctctgcccggcagccgccccgtctgacaaattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacaacaaacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaa

SEQ ID NO: 8377 - DNA, 1582 bp, synthetic construct; identical to SEQ ID NO: 7488
  misc_feature 1..1582: note = Synthetic polypeptide
  source 1..1582: mol_type = other DNA

SEQ ID NO: 8378 - DNA, 265 bp, synthetic construct
  misc_feature 1..265: note = Synthetic polypeptide
  source 1..265: mol_type = other DNA
gctatgtggccttggacagatcaccctcaccctctgattaaaaaatttcccatttgcaaatagggctttattacttggatcatatgtgaatctaaggatggacaaaaagggcacaaattacctcgccgatgtctttgagaaaaaggacaagaatgaggataagaagattgatttttctgagtttctgtccttgctgggagacatagccacagactaccacaagcagagccatggagcagcgccctgttccgggggcagccagtga

SEQ ID NO: 8379 - DNA, 333 bp, synthetic construct; identical to SEQ ID NO: 6583
  misc_feature 1..333: note = Synthetic polypeptide
  source 1..333: mol_type = other DNA

SEQ ID NO: 8380 - DNA, 238 bp, synthetic construct; identical to SEQ ID NO: 6628
  misc_feature 1..238: note = Synthetic polypeptide
  source 1..238: mol_type = other DNA

SEQ ID NO: 8381 - DNA, 3882 bp, synthetic construct
  misc_feature 1..3882: note = Synthetic polypeptide
  source 1..3882: mol_type = other DNA
ctctccctctccctctccctctttctccctctccctctccccatggtctccctctccctctctttccacggtctccctctgatgccgagccaaagctggactgtactgccgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggctggtctccagctcctagccgcgagtgatctgccagcctcggcatcctgaggtgccgggattgcagacggagtctggttcactcagtgctcaatggtgcccaggctggagtgcagtggcgtgatctcggctcgctacaacatccacctcccagccgcctgccttggcctcccaaagtgccgagattgcagcctctgcccggccaccaccccgtctgggaagtgaggagcgtctctgcctggccgcccatcgtctgggacatgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccacccatcgtctgagatgtggggagcgcctctgccccgccgccccatctgggatgtgaggagcgcctctgcccagccgcgaccccgtctgggaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagggggaaggttcctcctcattcttgtcggaaacttgccatgaggatccctctgtttcccccaactttactccccccaaccctcaagctctcaagtggtga

SEQ ID NO: 8382 - DNA, 4011 bp, synthetic construct
  misc_feature 1..4011: note = Synthetic polypeptide
  source 1..4011: mol_type = other DNA
ctctccctctccctctccctctttctccctctccctctccccatggtctccctctccctctctttccacggtctccctctgatgccgagccaaagctggactgtactgccgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggctggtctccagctcctagccgcgagtgatctgccagcctcggcatcctgaggtgccgggattgcagacggagtctggttcactcagtgctcaatggtgcccaggctggagtgcagtggcgtgatctcggctcgctacaacatccacctcccagccgcctgccttggcctcccaaagtgccgagattgcagcctctgcccggccaccaccccgtctgggaagtgaggagcgtctctgcctggccgcccatcgtctgggacatgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccacccatcgtctgagatgtggggagcgcctctgccccgccgccccatctgggatgtgaggagcgcctctgcccagccgcgaccccgtctgggaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtga

SEQ ID NO: 8383 - DNA, 1060 bp, synthetic construct
  misc_feature 1..1060: note = Synthetic polypeptide
  source 1..1060: mol_type = other DNA
ctctccctctccctctccctctttctccctctccctctccccatggtctccctctccctctctttccacggtctccctctgatgccgagccaaagctggactgtactgccgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggctggtctccagctcctagccgcgagtgatctgccagcctcggcatcctgaggtgccgggattgcagacggagtctggttcactcagtgctcaatggtgcccaggctggagtgcagtggcgtgatctcggctcgctacaacatccacctcccagccgcctgccttggcctcccaaagtgccgagattgcagcctctgcccggccaccaccccgtctgggaagtgaggagcgtctctgcctggccgcccatcgtctgggacatgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccacccatcgtctgagatgtggggagcgcctctgccccgccgccccatctgggatgtgaggagcgcctctgcccagccgcgaccccgtctgggaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaagggtggaaaaagctaatgaggctgcgaaaagtgagcagagctgtggaaaggctcccccaaaacattttcaccttcattttataaagcaaaataaaatgcttgaacctg

SEQ ID NO: 8384 - DNA, 370 bp, synthetic construct; identical to SEQ ID NO: 6522
  misc_feature 1..370: note = Synthetic polypeptide
  source 1..370: mol_type = other DNA

SEQ ID NO: 8385 - DNA, 2003 bp, synthetic construct
  misc_feature 1..2003: note = Synthetic polypeptide
  source 1..2003: mol_type = other DNA
caacactgtcaacagaacttcctgcaacggcagacagagggggatgttctgtatctgcacggtcagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccaatattaatgactgcagccagaacccctgccacaatgggggcacgtgtcgcgacctggtcaatgacttctactgtgactgtaaaaatgggtggaaaggaaagacctgccactcacgtgacagtcagtgtgatgaggccacgtgcaacaacggtggcacctgctatgatgagggggatgcttttaagtgcatgtgtcctggcggctgggaaggaacaacctgtaacatagcccgaaacagtagctgcctgcccaacccctgccataatgggggcacatgtgtggtcaacggcgagtcctttacgtgcgtctgcaaggaaggctgggaggggcccatctgtgctcagaataccaatgactgcagccctcatccctgttacaacagcggcacctgtgtggatggagacaactggtaccggtgcgaatgtgccccgggttttgctgggcccgactgcagaataaacatcaatgaatgccagtcttcaccttgtgcctttggagcgacctgtgtggatgagatcaatggctaccggtgtgtctgccctccagggcacagtggtgccaagtgccaggaagtttcagggagaccttgcatcaccatggggagtgtgataccagatggggccaaatgggatgatgactgtaatacctgccagtgcctgaatggacggatcgcctgctcaaaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccaggtcttactacggagcacatttgcagtgaattgaggaatttgaatattttgaagaatgtttccgctgaatattcaatctacatcgcttgcgagccttccccttcagcgaacaatgaaatacatgtggccatttctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattatgagaacaagaactccaaaatgtctaaaataaggacacacaattctgaagtagaagaggacgacatggacaaacaccagcagaaagcccggtttgccaagcagccggcgtacacgctggtagacagagaagagaagccccccaacggcacgccgacaaaacacccaaactggacaaacaaacaggacaacagagacttggaaagtgcccagagcttaaaccgaatggagtacatcgtatag

SEQ ID NO: 8386 - DNA, 763 bp, synthetic construct; identical to SEQ ID NO: 606
  misc_feature 1..763: note = Synthetic polypeptide
  source 1..763: mol_type = other DNA

SEQ ID NO: 8387 - DNA, 1084 bp, synthetic construct; identical to SEQ ID NO: 580
  misc_feature 1..1084: note = Synthetic polypeptide
  source 1..1084: mol_type = other DNA

SEQ ID NO: 8388 - DNA, 117 bp, synthetic construct
  misc_feature 1..117: note = Synthetic polypeptide
  source 1..117: mol_type = other DNA
ctgctgctgctgctgcttctgctggtgcccacagtttgtgtgctgcggagatcgcctgatggggcccctgtgcaagtctttgtacctgaaaaaggagagatcatcagccaggtgtaa

SEQ ID NO: 8389 - DNA, 2534 bp, synthetic construct; identical to SEQ ID NO: 586
  misc_feature 1..2534: note = Synthetic polypeptide
  source 1..2534: mol_type = other DNA

SEQ ID NO: 8390 - DNA, 1731 bp, synthetic construct
  misc_feature 1..1731: note = Synthetic polypeptide
  source 1..1731: mol_type = other DNA
aatctaatcaagtcttcactacaactaccaacacataggaaaaactaggtgagagaaggcgttatgtgataccaacaggaagcaatgagtcaaatccagaatatgaacattctatagaaacaaacaaacaaaaattccacaaatcaatggcaaataaaagaaaaagacagggttcattacagaataaataaccttaaaagacatggcagccgaattctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcactgtcaaccagagtctcctgactcccctcaacctgcaaattgaccccgccatccagcgggtgcgggccgaggagcgtgagcagatcaagaccctcaacaacaagtttgcctccttcatcgacaaggtgcggttcctagagcagcagaacaaggttctggacaccaagtggaccctgctgcaggagcagggcaccaagactgtgaggcagaacctggagccgttgttcgagcagtacatcaacaacctcaggaggcagctggacaacatcgtgggggaacggggtcgtctggactcggagctgagaaacatgcaggacctggtggaggacctcaagaacaaatatgaggatgaaatcaacaagcgcacagcagcagagaatgaatttgtgactctgaagaaggatgtggatgctgcctacatgaacaaggttgaactgcaagccaaggcagacactcttacagatgagatcaacttcctgagagccttgtatgatgcagagctgtcccagatgcagacccacatctcagacacatccgtggtgctatccatggacaacaaccgcaacctggacctggacagcatcatcgctgaggtcaaggcccaatatgaggagattgctcagaggagcagggctgaggctgagtcctggtaccagacaaagtacgaggagctgcagatcacagcaggcagacatggggacgacctgcgcaacaccaagcaggagattgctgagatcaaccgcatgatccagaggctgagatctgagatcgaccacgtcaagaagcagtgtgccaacctacaggccgccattgctgatgctgagcagcgtggggagatggccctcaaggatgctaagaacaagctggaagggctggaggatgccctgcagaaggccaagcaggacctggcccggctgctgaaggagtaccaggagctgatgaacgtcaagctggccctggatgtggagatcgccacctaccgcaagctgctggagggcgaggagtgcaggctgaatggcgaaggcgttggacaagtcaacatctctgtagtgcagtccaccgtctccagtggctatggcggtgccagcggtgtcggcagtggcttaggcctgggtggaggaagcagctactcctatggcagtggtcttggcgttggaggcggctttagttccagcagcggcagagccactgggggtggcctcagctctgttggaggcggcagttccaccatcaagtacaccaccacctcctcctccagcaggaagagctacaagcactga

SEQ ID NO: 8391 - DNA, 423 bp, synthetic construct; identical to SEQ ID NO: 6550
  misc_feature 1..423: note = Synthetic polypeptide
  source 1..423: mol_type = other DNA

SEQ ID NO: 8392 - DNA, 4417 bp, synthetic construct
  misc_feature 1..4417: note = Synthetic polypeptide
  source 1..4417: mol_type = other DNA
gtatggcataatgaaacgggtccagccttaggagtcaaactgatcttggctcactcaaattcccccactctgccacttctaccttttacaacctagggtcattatttaatttctgtgatcatgaatgataccgagggggtgatgatatctgcgtggtaggttatttatgaagggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggtgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaa

SEQ ID NO: 8393 - DNA, 1808 bp, synthetic construct
  misc_feature 1..1808: note = Synthetic polypeptide
  source 1..1808: mol_type = other DNA
ctctccctctccccctctccccctctccccctctccccctctccccctctcccctttccaccgtctccctctgatgccgagccgaggctggactgtactgccgccatcttggctcactgcaacctccctgcctgattctcctgcctcagcctgccgagtgcctgggattgcaggcgcgtgccgccacgcctgcaatttgtattttttggtggagacggggtttcgctgtgttggccgggctggtctccagctcctgaccgcgagtgatctacccgcctcggcgtcccgaggtgccgggattgcagacggagtctcgctcactcagtgctcaatgttgcccaggctggagtgcagtggcgtgatctcagctcgctacaacctccacctcccagccgcctgccttggcctcccaaagtgccgagattgcagcctctgcctggctgccaccccatctgggaagtgaggagcgtctctgcctggccgcccatcgtctgggatgtgaggagcccctctgcccggccgcccagtcttggaagtgaggagcgcatcttcccggccgccatcacgtctgggaagtgaggagcgtctctgcccggctgcccatcgtctcagatgtggggagcacctctgccccgccgccccgtctgggatgtgaggagcgcctctgtccggccgcgacccggtctgggaactgaggagtgtctctgcccgaccgccaccccgtctgggaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctag

SEQ ID NO: 8394 - DNA, 1218 bp, synthetic construct
  misc_feature 1..1218: note = Synthetic polypeptide
  source 1..1218: mol_type = other DNA
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgagaagcccctccgcccggcagccaccccgtctgggaagtgaggagcgtctccacccggcagccaccccgtccgggagggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctag

SEQ ID NO: 8395 - DNA, 1053 bp, synthetic construct
  misc_feature 1..1053: note = Synthetic polypeptide
  source 1..1053: mol_type = other DNA
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgagaagcccctccgcccggcagccaccccgtctgggaagtgaggagcgtctccacccggcagccaccccgtccgggagggaggtgtgaccatgaagctcatggatgaggtcgccgggatcgtggctgcacgccactgcaagaccaacatcgtcacagcttccgtggacgccattaattttcatgacaagatcagaaaagctcacgtaatgcctgctggcgctgaccacacagctccttcctcctctcccagcactggcacgaagtgctccctgctgcgtcatcaccatctcgggacgcatgaccttcacgagcaataa

SEQ ID NO: 8396 - DNA, 942 bp, synthetic construct
  misc_feature 1..942: note = Synthetic polypeptide
  source 1..942: mol_type = other DNA
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgagaagcccctccgcccggcagccaccccgtctgggaagtgaggagcgtctccacccggcagccaccccgtccgggagggaggtgtgaccatgaagctcatggatgaggtcgccgggatcgtggctgcacgccactgcaagaccaacatcgtcacagcttccgtggacgccattaattttcatgacaagatcagaaaagctccttag

SEQ ID NO: 8397 - DNA, 1091 bp, synthetic construct
  misc_feature 1..1091: note = Synthetic polypeptide
  source 1..1091: mol_type = other DNA
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgagaagcccctccgcccggcagccaccccgtctgggaagtgaggagcgtctccacccggcagccaccccgtccgggagggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaagg

SEQ ID NO: 8398 - DNA, 785 bp, synthetic construct; identical to SEQ ID NO: 6642
  misc_feature 1..785: note = Synthetic polypeptide
  source 1..785: mol_type = other DNA

SEQ ID NO: 8399 - DNA, 440 bp, synthetic construct; identical to SEQ ID NO: 6643
  misc_feature 1..440: note = Synthetic polypeptide
  source 1..440: mol_type = other DNA

SEQ ID NO: 8400 - DNA, 2158 bp, synthetic construct
  misc_feature 1..2158: note = Synthetic polypeptide
  source 1..2158: mol_type = other DNA
caccctgtctaaaactgtaacatcctcttcattgacagtgttttcatttcttgcttagcagtgatcagcactgacatgctgtccatttactcatcacccccaccatttacacacaggtgcacttgagtgccagctctgccagggaaggatttgtgtccctttcttccctgctgtattccccgtgcctcaaacagtgcctggcacagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaagaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagaggcggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactga

SEQ ID NO: 8401 - DNA, 2224 bp, synthetic construct
  misc_feature 1..2224: note = Synthetic polypeptide
  source 1..2224: mol_type = other DNA
caccctgtctaaaactgtaacatcctcttcattgacagtgttttcatttcttgcttagcagtgatcagcactgacatgctgtccatttactcatcacccccaccatttacacacaggtgcacttgagtgccagctctgccagggaaggatttgtgtccctttcttccctgctgtattccccgtgcctcaaacagtgcctggcacagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagaggcggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactga

SEQ ID NO: 8402 - DNA, 2143 bp, synthetic construct
  misc_feature 1..2143: note = Synthetic polypeptide
  source 1..2143: mol_type = other DNA
caccctgtctaaaactgtaacatcctcttcattgacagtgttttcatttcttgcttagcagtgatcagcactgacatgctgtccatttactcatcacccccaccatttacacacaggtgcacttgagtgccagctctgccagggaaggatttgtgtccctttcttccctgctgtattccccgtgcctcaaacagtgcctggcacagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagaggcggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactga

SEQ ID NO: 8403 - DNA, 796 bp, synthetic construct
  misc_feature 1..796: note = Synthetic polypeptide
  source 1..796: mol_type = other DNA
caccctgtctaaaactgtaacatcctcttcattgacagtgttttcatttcttgcttagcagtgatcagcactgacatgctgtccatttactcatcacccccaccatttacacacaggtgcacttgagtgccagctctgccagggaaggatttgtgtccctttcttccctgctgtattccccgtgcctcaaacagtgcctggcacagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaag

SEQ ID NO: 8404 - DNA, 2317 bp, synthetic construct
  misc_feature 1..2317: note = Synthetic polypeptide
  source 1..2317: mol_type = other DNA
ctggtcccttctgtcatccatctcgtcatcctaccccacacaccttgtattaggaccctcaaccatattaaattattagaattcactagactctctgtggtgtgttcatagtttatgttctttgcaagggttttctttcagcctgtcatgccttttcctttcactgactggcaagttcctaatcattttccaagacttaactgaaataccatctatgagaaactgttttgaacgctctcccacacatctaggttgattagttgctccttgtctgtgctcaggcaacactttatgcttcagttagcacactgtagtgtcatgtttacatattttcttatctgtcttatgtagacttgagcttcctgaaggtagagactgtgaggattattctaattattattattattactgttttggtcattgttttagcatgcctagaacagatccagcacaatgcctgtaacccagtagatgtcagataaatgttatggtggagaattcagactttaccccctcacaagtaggatgtctctttaccttccttgctcggcagcttgcaaagcctgacaacaccttgtttgtaaacagaacactttttgatcaggtccttgaattcctttgtagtcctgacgatgactcccgacactctgaaagacagcaggtccttttagaattgctgcaggctggaggcatagttcaatttgaagagagtcgactcatccggatggcagaaaaagctgagttctatcaaatttgtgaatttatgtatgaaagagaacaccaatatgataaaattattgattgctacttacgtgaccctctgcgagaggaagaagtctttaattacattcacaatatcttatccattcccggacacagtgcagaggagaagcagtctgtatggcagaaagcaatggatcatattgaggaactcgtgtccctgaagccttgtaaagctgcggagctggttgccacccacttttctggacatattgaaacggtcattaaaaaacttcagaaccaggttttgcttttcaaatttttgaggagtcttcttgacccaagggaaggtattcatgtaaatcaagaattactgcaaatatctccttgtatcacagagcagttcattgagctgttgtgtcagttcaacccaacccaagttatagagactctgcaagtccttgagtgctaccgtctggaagaaactattcagattactcagaagtatcaacttcatgaagtcaccgcttatctattggaaaagaaaggagatattcatggtgccttcctaataatgttagagagactacaaagcaaacttcaagaggtaacacatcaaggtgaaaataccaaagaggatccctcattgaaggatgttgaagatactatggtggagaccattgctctttgccagagaaattcacataatttgaaccagcagcaacgtgaggcactttggtttccgttattggaggcaatgatggcccctcagaagctgtccagttcagccattcctcatctacactctgaagctctgaagtctttgaccatgcaagttttaaatagcatggcagcatttattgcccttccatcaatcttgcaaagaatcttacaggatccagtttatggaaaaggaaaacttggagaaatccagggacttatcttgggaatgttagatacctttaactatgaacaaaccctgctggaaacaacaaccagccttctaaaccaagatctccattggtcattgtgtaacctgagagcttcggtcaccagaggactgaatcccaaacaagattactgctctatatgtttgcagcagtacaagagacgccaagaaatggctgatgaaataattgtctttagctgtggccatttgtatcactcattctgcctacaaaacaaagaatgcactgtggaatttgagggccaaacaagatggacatgctacaaatgcagttcaagtaacaaagtaggaaaactcagtgaaaattcatctgaaattaaaaagggaaggataaccccatcacaggtaaaaatgtctccatcgtatcatcagtccaaaggggatcccactgctaaaaagggaacctcagaacctgttctggatccacagcaaatccaagcatttgatcagctttgccgtctctaccgaggaagctccaggctggctctcctcacggaactctcccagaatcgcagcagcgagagctataggccattcagtggctcgcagagtgctcctgctttcaacagcatcttccagaatgagaacttccagctgcagctcattcctccacctgtgactgaggattga

SEQ ID NO: 8405 - DNA, 564 bp, synthetic construct
  misc_feature 1..564: note = Synthetic polypeptide
  source 1..564: mol_type = other DNA
ctcttctgcccttgccgagaactctgtctatatctgtattacaacacttaccatagtgtattcattttacaaggtattgcacccagtgaaccatgaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactga

SEQ ID NO: 8406 - DNA, 198 bp, synthetic construct
  misc_feature 1..198: note = Synthetic polypeptide
  source 1..198: mol_type = other DNA
ggctgagtgcggtggctcacacctgtaatcccagcacttaggacggccaagagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctga

SEQ ID NO: 8407 - DNA, 2256 bp, synthetic construct
  misc_feature 1..2256: note = Synthetic polypeptide
  source 1..2256: mol_type = other DNA
ggttcctcaaaagattaaacatagaactagcatatgatccagcaattctacttatgggtatgcacgcaaaagaagggaagacaggaacttgagagatatttgcacacctgtgttcatagcagcattattcacaatagccaaaaggtggaagcaacccacgtgtccatcagtggatgaatggataaagaaagtgtgatatatacatgcactggaatattattcggccttaaaaagaaaggaaattctgacattctacaacatggaagaactttgatgacattatgctgagtgaaataagccaacagcaaaggacaaatattgtatgattttacttacatgaggtaccatagccaaattcatagaaacagaaagtagaatgtgcctagcccctcctgtaatggttttgacaacaccctttcaagaccttgccgggtgccactaggaaaggaggtttgcttcattgccaccgttcgtctggcaacaccacaattcttaaaggaaatgtgcatagttgacgaacctttagaggaattcacttcaaggcatagcttggaatggaaatttttatttctggatcacagagcacctccaatcataggatacctgccttttgaagtgctgggaacctcaggctatgactactaccacattgatgacctggagctcctggccaggtgtcaccagcacctgatgcagtttggcaaagggaagtcgtgttgctaccggtttctgaccaaaggtcagcagtggatctggctgcagactcactactacatcacctaccatcagtggaactccaagcccgagttcatcgtgtgcacacactcggtggtcagttacgcagatgtccgggtggaaaggaggcaggagctggctctggaagacccgccatccgaggccctccactcctcagcactaaaggacaagggctcaagcctggaacctcggcagcactttaacacactcgacgtgggtgcctcgggccttaataccagtcattcgccatcggcgtcctcaagaagttcccacaaatcctcgcacacagccatgtcagaacccacctccactcccaccaagctgatggcagaggccagcaccccggctttgccaagatcagccaccctgccccaagagttacctgtccccgggctcagccaggcagccaccatgccggcccctctgccttccccatcgtcctgcgacctcacacagcagctcctgcctcagaccgttctgcagagcacgcccgctcccatggcacagttttcggcacagttcagcatgttccagaccatcaaagaccagctagagcagcggacgcggatcctgcaggccaatatccggtggcaacaggaagagctccacaagatccaggagcagctctgcctggtccaggactccaacgtccagatgttcctgcagcagccagctgtatccctgagcttcagcagcacccagcgacctgaggctcagcagcagctacagcaaaggtcagctgcagtgactcagccccagctcggggcgggcccccaacttccagggcagatctcctctgcccaggtcacaagccagcacctgctcagagaatcaagtgtgatatcaacccagggtccaaagccaatgagaagctcacagctaatgcagagcagcggccgctctggaagcagcctagtgtccccgttcagcagcgccacagctgcgctcccgccaagtctgaatctgaccacacctgcttccacctcccaggatgccagccagtgccagcccagcccagacttcagccatgatcggcagctcaggctgttgctgagccagcccatccagcccatgatgcccgggtcctgtgacgcaaggcagccctcggaagtcagcaggacgggacggcaagtcaagtacgcccagagccagaccgtgtttcaaaatccagacgcacaccccgccaacagcagcagcgccccgatgcccgtcctgctgatggggcaggcggtgctccaccccagcttccctgcctcccaaccatcgcccctgcagcctgcacaggcccggcagcagccaccgcagcactacctgcaggtacaggcaccaacctctttgcacagtgagcagcaggactcgctacttctctccacctactcacaacagccagggaccctgggctacccccaaccacccccagcacagccccagcccctacgtcctccccgaagggtcagcagtctgtctgagtcgtcaggcctccagcagccgccccgataa

SEQ ID NO: 8408 - DNA, 2624 bp, synthetic construct
  misc_feature 1..2624: note = Synthetic polypeptide
  source 1..2624: mol_type = other DNA
ggctgagcgcagtggctcatgcctgtagtcccagctacttgggaggccaaggcaggagctccgatcacttgagcccaggagtttgaggctgctgtaagctgagattgtgccactggactccagtctgagcgacagtgaggatgtctcaaaaaaataaataaaaaccgctcatgaatagagctgagcgtggtggtcccacacctgtagtcccagctactcaggaggctgagtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaagttcaatctcatccctcccagcagctccccttccaccccccggggaactga

SEQ ID NO: 8409 - DNA, 2678 bp, synthetic construct
  misc_feature 1..2678: note = Synthetic polypeptide
  source 1..2678: mol_type = other DNA
ggctgagcgcagtggctcatgcctgtagtcccagctacttgggaggccaaggcaggagctccgatcacttgagcccaggagtttgaggctgctgtaagctgagattgtgccactggactccagtctgagcgacagtgaggatgtctcaaaaaaataaataaaaaccgctcatgaatagagctgagcgtggtggtcccacacctgtagtcccagctactcaggaggctgagtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcctccccttccaccccccggggaactgaagattgtcctggccgcgacctga

SEQ ID NO: 8410 - DNA, 2717 bp, synthetic construct
  misc_feature 1..2717: note = Synthetic polypeptide
  source 1..2717: mol_type = other DNA
ggctgagcgcagtggctcatgcctgtagtcccagctacttgggaggccaaggcaggagctccgatcacttgagcccaggagtttgaggctgctgtaagctgagattgtgccactggactccagtctgagcgacagtgaggatgtctcaaaaaaataaataaaaaccgctcatgaatagagctgagcgtggtggtcccacacctgtagtcccagctactcaggaggctgagtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcgtgagttctcattagctgggggaatttggcatggaagagctgaggggctgcaggtggggcaggatgcacgggttctgggtggggagtga

SEQ ID NO: 8411 - DNA, 2624 bp, synthetic construct
  misc_feature 1..2624: note = Synthetic polypeptide
  source 1..2624: mol_type = other DNA
ggctgagcgcagtggctcatgcctgtagtcccagctacttgggaggccaaggcaggagctccgatcacttgagcccaggagtttgaggctgctgtaagctgagattgtgccactggactccagtctgagcgacagtgaggatgtctcaaaaaaataaataaaaaccgctcatgaatagagctgagcgtggtggtcccacacctgtagtcccagctactcaggaggctgagtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaagctccccttccaccccccggggaactgaagattgtcctggccgcgacctga

SEQ ID NO: 8412 - DNA, 2783 bp, synthetic construct
  misc_feature 1..2783: note = Synthetic polypeptide
  source 1..2783: mol_type = other DNA
ggctgagcgcagtggctcatgcctgtagtcccagctacttgggaggccaaggcaggagctccgatcacttgagcccaggagtttgaggctgctgtaagctgagattgtgccactggactccagtctgagcgacagtgaggatgtctcaaaaaaataaataaaaaccgctcatgaatagagctgagcgtggtggtcccacacctgtagtcccagctactcaggaggctgagtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattctatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttag

SEQ ID NO: 8413 - DNA, 2696 bp, synthetic construct
  misc_feature 1..2696: note = Synthetic polypeptide
  source 1..2696: mol_type = other DNA
ggctgagcgcagtggctcatgcctgtagtcccagctacttgggaggccaaggcaggagctccgatcacttgagcccaggagtttgaggctgctgtaagctgagattgtgccactggactccagtctgagcgacagtgaggatgtctcaaaaaaataaataaaaaccgctcatgaatagagctgagcgtggtggtcccacacctgtagtcccagctactcaggaggctgagtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagctcccccttttcttccagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcttcaatctcatccctcccagcagctccccttccaccccccggggaactga

SEQ ID NO: 8414 - DNA, 2678 bp, synthetic construct
  misc_feature 1..2678: note = Synthetic polypeptide
  source 1..2678: mol_type = other DNA
ggctgagcgcagtggctcatgcctgtagtcccagctacttgggaggccaaggcaggagctccgatcacttgagcccaggagtttgaggctgctgtaagctgagattgtgccactggactccagtctgagcgacagtgaggatgtctcaaaaaaataaataaaaaccgctcatgaatagagctgagcgtggtggtcccacacctgtagtcccagctactcaggaggctgagtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcttcaatctcatccctcccagcagctccccttccaccccccggggaactga

SEQ ID NO: 8415 - DNA, 677 bp, synthetic construct
  misc_feature 1..677: note = Synthetic polypeptide
  source 1..677: mol_type = other DNA
ggctgagcgcagtggctcatgcctgtagtcccagctacttgggaggccaaggcaggagctccgatcacttgagcccaggagtttgaggctgctgtaagctgagattgtgccactggactccagtctgagcgacagtgaggatgtctcaaaaaaataaataaaaaccgctcatgaatagagctgagcgtggtggtcccacacctgtagtcccagctactcaggaggctgagtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttct

SEQ ID NO: 8416 - DNA, 739 bp, synthetic construct
  misc_feature 1..739: note = Synthetic polypeptide
  source 1..739: mol_type = other DNA
ccagggggaattttagaaaatgttgtggcccactttctttgagagaccccttgtgaggaaagcctttgagaagaccctcaaggacctgaagctgagctatctggacgtctatcttattcactggccacagggattcaagtctggggatgaccttttccccaaagatgataaaggtaatgccatcggtggaaaagcaacgttcttggatgcctgggaggccatggaggagctggtggatgaggggctggtgaaagcccttggggtctccaatttcagccacttccagatcgagaagctcttgaacaaacctggactgaaatataaaccagtgactaaccaggttgagtgtcacccatacctcacacaggagaaactgatccagtactgccactccaagggcatcaccgttacggcctacagccccctgggctctccggatagaccttgggccaagccagaagacccttccctgctggaggatcccaagattaaggagattgctgcaaagcacaaaaaaaccgcagcccaggttctgatccgtttccatatccagaggaatgtgattgtcatccccaagtctgtgacaccagcacgcattgttgagaacattcaggtctttgactttaaattgagtgatgaggagatggcaaccatactcagcttcaacagaaactggagggcctgtaacgtgttgcaatcctctcatttggaagactatcccttcaatgcagaatattga

SEQ ID NO: 8417 - DNA, 3011 bp, synthetic construct
  misc_feature 1..3011: note = Synthetic polypeptide
  source 1..3011: mol_type = other DNA
ggccagccttggtggctcacgcctgtaatcccaacactttgggaggctgaggtggttggatcacttgaggtcaggagttcaagaccagcctggccaacatgagtttgtttctaatggaagaggttcacatgataaagaacaaaccagccagtcctcacatcaagatagagatgaaaaatgccaccttggcatgggactcctcccactccagtatccagaactcgcccaagctgacccccaaaatgaaaaaagacaagagggcttccaggggcaagaaagagaaggtgaggcagctgcagcgcactgagcatcaggcggtgctggcagagcagaaaggccacctcctcctggacagtgacgagcggcccagtcccgaagaggaagaaggcaagcacatccacctgggccacctgcgcttacagaggacactgcacagcatcgatctggagatccaagagggtaaactggttggaatctgtggcagtgtgggaagtggaaaaacctctctcatttcagccattttaggccagatgacgcttctagagggcagcattgcaatcagtggaaccttcgcttatgtggcccagcaggcctggatcctcaatgctactctgagagacaacatcctgtttgggaaggaatatgatgaagaaagatacaactctgtgctgaacagctgctgcctgaggcctgacctggccattcttcccagcagcgacctgacggagattggagagcgaggagccaacctgagcggtgggcagcgccagaggatcagccttgcccgggccttgtatagtgacaggagcatctacatcctggacgaccccctcagtgccttagatgcccatgtgggcaaccacatcttcaatagtgctatccggaaacatctcaagtccaagacagttctgtttgttacccaccagttacagtacctggttgactgtgatgaagtgatcttcatgaaagagggctgtattacggaaagaggcacccatgaggaactgatgaatttaaatggtgactatgctaccatttttaataacctgttgctgggagagacaccgccagttgagatcaattcaaaaaaggaaaccagtggttcacagaagaagtcacaagacaagggtcctaaaacaggatcagtaaagaaggaaaaagcagtaaagccagaggaagggcagcttgtgcagctggaagagaaagggcagggttcagtgccctggtcagtatatggtgtctacatccaggctgctgggggccccttggcattcctggttattatggcccttttcatgctgaatgtaggcagcaccgccttcagcacctggtggttgagttactggatcaagcaaggaagcgggaacaccactgtgactcgagggaacgagacctcggtgagtgacagcatgaaggacaatcctcatatgcagtactatgccagcatctacgccctctccatggcagtcatgctgatcctgaaagccattcgaggagttgtctttgtcaagggcacgctgcgagcttcctcccggctgcatgacgagcttttccgaaggatccttcgaagccctatgaagttttttgacacgacccccacagggaggattctcaacaggttttccaaagacatggatgaagttgacgtgcggctgccgttccaggccgagatgttcatccagaacgttatcctggtgttcttctgtgtgggaatgatcgcaggagtcttcccgtggttccttgtggcagtggggccccttgtcatcctcttttcagtcctgcacattgtctccagggtcctgattcgggagctgaagcgtctggacaatatcacgcagtcacctttcctctcccacatcacgtccagcatacagggccttgccaccatccacgcctacaataaagggcaggagtttctgcacagataccaggagctgctggatgacaaccaagctcctttttttttgtttacgtgtgcgatgcggtggctggctgtgcggctggacctcatcagcatcgccctcatcaccaccacggggctgatgatcgttcttatgcacgggcagattcccccagcctatgcgggtctcgccatctcttatgctgtccagttaacggggctgttccagtttacggtcagactggcatctgagacagaagctcgattcacctcggtggagaggatcaatcactacattaagactctgtccttggaagcacctgccagaattaagaacaaggctccctcccctgactggccccaggagggagaggtgacctttgagaacgcagagatgaggtaccgagaaaacctccctctcgtcctaaagaaagtatccttcacgatcaaacctaaagagaagattggcattgtggggcggacaggatcagggaagtcctcgctggggatggccctcttccgtctggtggagttatctggaggctgcatcaagattgatggagtgagaatcagtgatattggccttgccgacctccgaagcaaactctctatcattcctcaagagccggtgctgttcagtggcactgtcagatcaaatttggaccccttcaaccagtacactgaagaccagatttgggatgccctggagaggacacacatgaaagaatgtattgctcagctacctctgaaacttgaatctgaagtgatggagaatggggataacttctcagtgggggaacggcagctcttgtgcatagctagagccctgctccgccactgtaagattctgattttagatgaagccacagctgccatggacacagagacagacttattgattcaagagaccatccgagaagcatttgcagactgtaccatgctgaccattgcccatcgcctgcacacggttctaggctccgataggattatggtgctggcccagggacaggtggtggagtttgacaccccatcggtccttctgtccaacgacagttcccgattctatgccatgtttgctgctgcagagaacaaggtcgctgtcaagggctga

SEQ ID NO: 8418 - DNA, 2882 bp, synthetic construct
  misc_feature 1..2882: note = Synthetic polypeptide
  source 1..2882: mol_type = other DNA
ggccagccttggtggctcacgcctgtaatcccaacactttgggaggctgaggtggttggatcacttgaggtcaggagttcaagaccagcctggccaacatgagtttgtttctaatggaagaggttcacatgataaagaacaaaccagccagtcctcacatcaagatagagatgaaaaatgccaccttggcatgggactcctcccactccagtatccagaactcgcccaagctgacccccaaaatgaaaaaagacaagagggcttccaggggcaagaaagagaaggtgaggcagctgcagcgcactgagcatcaggcggtgctggcagagcagaaaggccacctcctcctggacagtgacgagcggcccagtcccgaagaggaagaaggcaagcacatccacctgggccacctgcgcttacagaggacactgcacagcatcgatctggagatccaagagggtaaactggttggaatctgtggcagtgtgggaagtggaaaaacctctctcatttcagccattttaggccagatgacgcttctagagggcagcattgcaatcagtggaaccttcgcttatgtggcccagcaggcctggatcctcaatgctactctgagagacaacatcctgtttgggaaggaatatgatgaagaaagatacaactctgtgctgaacagctgctgcctgaggcctgacctggccattcttcccagcagcgacctgacggagattggagagcgaggagccaacctgagcggtgggcagcgccagaggatcagccttgcccgggccttgtatagtgacaggagcatctacatcctggacgaccccctcagtgccttagatgcccatgtgggcaaccacatcttcaatagtgctatccggaaacatctcaagtccaagacagttctgtttgttacccaccagttacagtacctggttgactgtgatgaagtgatcttcatgaaagagggctgtattacggaaagaggcacccatgaggaactgatgaatttaaatggtgactatgctaccatttttaataacctgttgctgggagagacaccgccagttgagatcaattcaaaaaaggaaaccagtggttcacagaagaagtcacaagacaagggtcctaaaacaggatcagtaaagaaggaaaaagcagtaaagccagaggaagggcagcttgtgcagctggaagagaaagggcagggttcagtgccctggtcagtatatggtgtctacatccaggctgctgggggccccttggcattcctggttattatggcccttttcatgctgaatgtaggcagcaccgccttcagcacctggtggttgagttactggatcaagcaaggaagcgggaacaccactgtgactcgagggaacgagacctcggtgagtgacagcatgaaggacaatcctcatatgcagtactatgccagcatctacgccctctccatggcagtcatgctgatcctgaaagccattcgaggagttgtctttgtcaagggcacgctgcgagcttcctcccggctgcatgacgagcttttccgaaggatccttcgaagccctatgaagttttttgacacgacccccacagggaggattctcaacaggttttccaaagacatggatgaagttgacgtgcggctgccgttccaggccgagatgttcatccagaacgttatcctggtgttcttctgtgtgggaatgatcgcaggagtcttcccgtggttccttgtggcagtggggccccttgtcatcctcttttcagtcctgcacattgtctccagataccaggagctgctggatgacaaccaagctcctttttttttgtttacgtgtgcgatgcggtggctggctgtgcggctggacctcatcagcatcgccctcatcaccaccacggggctgatgatcgttcttatgcacgggcagattcccccagcctatgcgggtctcgccatctcttatgctgtccagttaacggggctgttccagtttacggtcagactggcatctgagacagaagctcgattcacctcggtggagaggatcaatcactacattaagactctgtccttggaagcacctgccagaattaagaacaaggctccctcccctgactggccccaggagggagaggtgacctttgagaacgcagagatgaggtaccgagaaaacctccctctcgtcctaaagaaagtatccttcacgatcaaacctaaagagaagattggcattgtggggcggacaggatcagggaagtcctcgctggggatggccctcttccgtctggtggagttatctggaggctgcatcaagattgatggagtgagaatcagtgatattggccttgccgacctccgaagcaaactctctatcattcctcaagagccggtgctgttcagtggcactgtcagatcaaatttggaccccttcaaccagtacactgaagaccagatttgggatgccctggagaggacacacatgaaagaatgtattgctcagctacctctgaaacttgaatctgaagtgatggagaatggggataacttctcagtgggggaacggcagctcttgtgcatagctagagccctgctccgccactgtaagattctgattttagatgaagccacagctgccatggacacagagacagacttattgattcaagagaccatccgagaagcatttgcagactgtaccatgctgaccattgcccatcgcctgcacacggttctaggctccgataggattatggtgctggcccagggacaggtggtggagtttgacaccccatcggtccttctgtccaacgacagttcccgattctatgccatgtttgctgctgcagagaacaaggtcgctgtcaagggctga

SEQ ID NO: 8419 - DNA, 950 bp, synthetic construct
  misc_feature 1..950: note = Synthetic polypeptide
  source 1..950: mol_type = other DNA
ctctgggaggatgaagttgagagaatacctaatattatcctcttgacttgaaccacagtgaaaccttcctgcaaactacaacatttcttcctgaagacttcacctactttgcaaaccatacctgccctgaaagactcccttccatgaagggcccaatagacataaacatgagtgaaattggaatggattacattcatgaactcttctccaaagacccaaccatcaagctcggaggtcactggaagccttctgattgcatgcctcggtggaaggtggcgatccttatccccttccggaaccgccacgagcacctcccagtcctgttcagacacctgcttcccatgctccagcgccagcgcttgcagtttgcattttatgtggttgaacaagttggtacccaaccctttaatcgagccatgcttttcaacgttggctttcaagaggcaatgaaagacttggattgggactgtttgatttttcatgatgtagatcacataccggaaagtgatcgcaactattatggatgtggacagatgccgaggcattttgcaaccaaattggataagtatatgtatctgcttccttataccgagttctttggcggagtgagtggcttaacagtggaacaatttcggaaaatcaatggctttcctaatgctttctggggttggggtggagaagatgacgacctctggaacagagtacagaatgcaggctattctgtgagccggccagagggtgacacaggaaagtacaagtccattcctcatcaccatcgaggagaagtccagtttcttggaaggtatgctctgctgaggaagtcaaaagaacggcaagggctggatggcctcaacaacctgaactactttgcaaacatcacatacgacgccttgtataaaaacataactgtcaacctgacacccgagctggctcaggtgaacgagtactga

SEQ ID NO: 8420 - DNA, 1086 bp, synthetic construct
  misc_feature 1..1086: note = Synthetic polypeptide
  source 1..1086: mol_type = other DNA
cttgctgttgtgtgacctggagaaggccttctctctccctgagcctcagtttccctatcatgacaaatggggaacccagtacttccttcccaaggcaagcgcctccaggagtggtgctctgtgatcctgtgcttcagcctcatcgcccacaacctggtccatctcctgctgctggcccgctgggaggacacacccctcgtcatactcggtgttgttgcaggggctctcattgctgacttcttgtctggcctggtacactggggtgctgacacatggggctctgtggagctgcccattgtggggaaggctttcatccgacccttccgggagcaccacattgacccgacagctatcacacggcacgacttcatcgagaccaacggggacaactgcctggtgacactgctgccgctgctaaacatggcctacaagttccgcacccacagccctgaagccctggagcagctatacccctgggagtgcttcgtcttctgcctgatcatcttcggcaccttcaccaaccagatccacaagtggtcgcacacgtactttgggctgccacgctgggtcaccctcctgcaggactggcatgtcatcctgccacgtaaacaccatcgcatccaccacgtctcaccccacgagacctacttctgcatcaccacaggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagaacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaa

SEQ ID NO: 8421 - DNA, 777 bp, synthetic construct
  misc_feature 1..777: note = Synthetic polypeptide
  source 1..777: mol_type = other DNA
cttgctgttgtgtgacctggagaaggccttctctctccctgagcctcagtttccctatcatgacaaatggggaacccagtacttccttcccaaggcaagcgcctccaggagtggtgctctgtgatcctgtgcttcagcctcatcgcccacaacctggtccatctcctgctgctggcccgctgggaggacacacccctcgtcatactcggtgttgttgcaggggctctcattgctgacttcttgtctggcctggtacactggggtgctgacacatggggctctgtggagctgcccattgctttcatccgacccttccgggagcaccacattgacccgacagctatcacacggcacgacttcatcgagaccaacggggacaactgcctggtgacactgctgccgctgctaaacatggcctacaagttccgcacccacagccctgaagccctggagcagctatacccctgggagtgcttcgtcttctgcctgatcatcttcggcaccttcaccaaccagatccacaagtggtcgcacacgtactttgggctgccacgctgggtcaccctcctgcaggactggcatgtcatcctgccacgtaaacaccatcgcatccaccacgtctcaccccacgagacctacttctgcatcaccacaggctggctcaactaccctctggagaagataggcttctggcgacgcctggaggacctcatccagggcctgacgggcgagaagcctcgggcagatgacatgaaatgggcccagaagatcaaataa

SEQ ID NO: 8422 - DNA, 786 bp, synthetic construct
  misc_feature 1..786: note = Synthetic polypeptide
  source 1..786: mol_type = other DNA
cttgctgttgtgtgacctggagaaggccttctctctccctgagcctcagtttccctatcatgacaaatggggaacccagtacttccttcccaaggcaagcgcctccaggagtggtgctctgtgatcctgtgcttcagcctcatcgcccacaacctggtccatctcctgctgctggcccgctgggaggacacacccctcgtcatactcggtgttgttgcaggggctctcattgctgacttcttgtctggcctggtacactggggtgctgacacatggggctctgtggagctgcccattgtggggaaggctttcatccgacccttccgggagcaccacattgacccgacagctatcacacggcacgacttcatcgagaccaacggggacaactgcctggtgacactgctgccgctgctaaacatggcctacaagttccgcacccacagccctgaagccctggagcagctatacccctgggagtgcttcgtcttctgcctgatcatcttcggcaccttcaccaaccagatccacaagtggtcgcacacgtactttgggctgccacgctgggtcaccctcctgcaggactggcatgtcatcctgccacgtaaacaccatcgcatccaccacgtctcaccccacgagacctacttctgcatcaccacaggctggctcaactaccctctggagaagataggcttctggcgacgcctggaggacctcatccagggcctgacgggcgagaagcctcgggcagatgacatgaaatgggcccagaagatcaaataa

SEQ ID NO: 8423 - DNA, 249 bp, synthetic construct
  misc_feature 1..249: note = Synthetic polypeptide
  source 1..249: mol_type = other DNA
cttgctgttgtgtgacctggagaaggccttctctctccctgagcctcagtttccctatcatgacaaatggggaacccagtacttccttcccaaggcaagcgcctccaggagtggtgctctgtgatcctgtgcttcagcctcatcgcccacaacctggtccatctcctgctgctggcccgctgggaggacacacccctcgtcatactcggtgttggctttcatccgacccttccgggagcaccacattga

SEQ ID NO: 8424 - DNA, 2419 bp, synthetic construct; identical to SEQ ID NO: 7455
  misc_feature 1..2419: note = Synthetic polypeptide
  source 1..2419: mol_type = other DNA

SEQ ID NO: 8425 - DNA, 2668 bp, synthetic construct
  misc_feature 1..2668: note = Synthetic polypeptide
  source 1..2668: mol_type = other DNA
ctctccctctccttcatctccgtctcccgctttccacggtctccccctctccctcgtctccgtctcccactttccacggtctccctctgttgccgaggctggactgtactgccgcgatctcggctcactgcaaccttcctgcctgattctcctgcctcagcctgccgagtgcctgggattgcaggcacgcgccgccacgcctgactggtttttgtgttttttggtggagacggggtttcgccatgttggccgggctggtctccagctcctgacctcgagtgatctgcccgcctcggcctcccgaggtgccgggattgcagacggagtctcgctcactcagtgctcaatgttgcccaggctggagtgcagtggcgtgatctcggctcgctacaacccccacctcccagccacctgccttggcctcccgaagtgctgagattgcagcctctgcccggccgccaccctgtctaggaagtgaggagcgtctctgcctggctgcccatcgtctgggatgtgaggagcccctctgcccggccgcccagtctgggaagtgaggagcgcctcttcccggccaccaccccgtctaggaagtgaggagcgtctctgcctggccgcccatcgtctgggatgtgaggagcccctctgcccagccacccagtctgggaagtgaggagtgcctcttcctggccgtcatcccgtctaggaagtgaggagcgtctctgcctggccgcccatcgtctgggatgtggggagcgcctctgcccggccgccaccctgtctgagaggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcctgggcagtgtgacgtttctggctggcaatcggatgctggcccagcaggcagtcaagagaacagcacattag

SEQ ID NO: 8426 - DNA, 2620 bp, synthetic construct
  misc_feature 1..2620: note = Synthetic polypeptide
  source 1..2620: mol_type = other DNA
ctctccctctccttcatctccgtctcccgctttccacggtctccccctctccctcgtctccgtctcccactttccacggtctccctctgttgccgaggctggactgtactgccgcgatctcggctcactgcaaccttcctgcctgattctcctgcctcagcctgccgagtgcctgggattgcaggcacgcgccgccacgcctgactggtttttgtgttttttggtggagacggggtttcgccatgttggccgggctggtctccagctcctgacctcgagtgatctgcccgcctcggcctcccgaggtgccgggattgcagacggagtctcgctcactcagtgctcaatgttgcccaggctggagtgcagtggcgtgatctcggctcgctacaacccccacctcccagccacctgccttggcctcccgaagtgctgagattgcagcctctgcccggccgccaccctgtctaggaagtgaggagcgtctctgcctggctgcccatcgtctgggatgtgaggagcccctctgcccggccgcccagtctgggaagtgaggagcgcctcttcccggccaccaccccgtctaggaagtgaggagcgtctctgcctggccgcccatcgtctgggatgtgaggagcccctctgcccagccacccagtctgggaagtgaggagtgcctcttcctggccgtcatcccgtctaggaagtgaggagcgtctctgcctggccgcccatcgtctgggatgtggggagcgcctctgcccggccgccaccctgtctgagaggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcctgggcagtgtgacgtttctggctggcaatcggatgctggcccagcaggcagtcaagaggatcgctgcagagcagagcagtagattggcaaaatataggacactacgaacagcacattag

SEQ ID NO: 8427 - DNA, 1806 bp, synthetic construct
  misc_feature 1..1806: note = Synthetic polypeptide
  source 1..1806: mol_type = other DNA
ctctccctctccttcatctccgtctcccgctttccacggtctccccctctccctcgtctccgtctcccactttccacggtctccctctgttgccgaggctggactgtactgccgcgatctcggctcactgcaaccttcctgcctgattctcctgcctcagcctgccgagtgcctgggattgcaggcacgcgccgccacgcctgactggtttttgtgttttttggtggagacggggtttcgccatgttggccgggctggtctccagctcctgacctcgagtgatctgcccgcctcggcctcccgaggtgccgggattgcagacggagtctcgctcactcagtgctcaatgttgcccaggctggagtgcagtggcgtgatctcggctcgctacaacccccacctcccagccacctgccttggcctcccgaagtgctgagattgcagcctctgcccggccgccaccctgtctaggaagtgaggagcgtctctgcctggctgcccatcgtctgggatgtgaggagcccctctgcccggccgcccagtctgggaagtgaggagcgcctcttcccggccaccaccccgtctaggaagtgaggagcgtctctgcctggccgcccatcgtctgggatgtgaggagcccctctgcccagccacccagtctgggaagtgaggagtgcctcttcctggccgtcatcccgtctaggaagtgaggagcgtctctgcctggccgcccatcgtctgggatgtggggagcgcctctgcccggccgccaccctgtctgagaggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcgagggtgtggagcaccgttctggaatcccgttcgttgtttagcaagagaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtagg

SEQ ID NO: 8428 - DNA, 1306 bp, synthetic construct
  misc_feature 1..1306: note = Synthetic polypeptide
  source 1..1306: mol_type = other DNA
tttcttggttccctgactgggaagcgaggtgattaacagacaatcgaggcagcccttaggcagcttaggcccgccctgtggagcatccctgcgggggactccggccagcttgagcgacacggatcctgagagcactcccatgtaggcaattgccccagtggaatgcctcgccagagcagtgcatggcaggcccttgtggaggatcaacacagcggctgaacaccaggaaggacatggcacttggagtctggacatctgaaacttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaagggggtgtcctggtcaatgaaatcctcaatcacatgaagagagcaactcagataccaagctacaaaaaactcatcatgtattctgcgcatgacactactgtgagtggcctacagatggcgctagatgtttacaacggactccttcctccctatgcttcttgccacttgacggaattgtactttgagaagggggagtactttgtggagatgtactatcggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaagacagtacagattag

SEQ ID NO: 8429 - DNA, 641 bp, synthetic construct
  misc_feature 1..641: note = Synthetic polypeptide
  source 1..641: mol_type = other DNA
tttcttggttccctgactgggaagcgaggtgattaacagacaatcgaggcagcccttaggcagcttaggcccgccctgtggagcatccctgcgggggactccggccagcttgagcgacacggatcctgagagcactcccatgtaggcaattgccccagtggaatgcctcgccagagcagtgcatggcaggcccttgtggaggatcaacacagcggctgaacaccaggaaggacatggcacttggagtctggacatctgaaacttggtgtttcggcatggagaccgaagtcccattgacacctttcccactgaccccataaaggaatcctcatggccacaaggatttggccaactcacccaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggattttatagctaccttgggaaaacttt

SEQ ID NO: 8430 - DNA, 1207 bp, synthetic construct
  misc_feature 1..1207: note = Synthetic polypeptide
  source 1..1207: mol_type = other DNA
tttcttggttccctgactgggaagcgaggtgattaacagacaatcgaggcagcccttaggcagcttaggcccgccctgtggagcatccctgcgggggactccggccagcttgagcgacacggatcctgagagcactcccatgtaggcaattgccccagtggaatgcctcgccagagcagtgcatggcaggcccttgtggaggatcaacacagcggctgaacaccaggaaggacatggcacttggagtctggacatctgaaacttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaagggggtgtcctggtcaatgaaatcctcaatcacatgaagagagcaactcagataccaagctacaaaaaactcatcatgtattctgcgcatgacactactgtgagtggcctacagatggcgctagatgtttacaacggactccttcctccctatgcttcttgccacttgacggaattgtactttgagaagggggagtactttgtggagatgtactatcggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaagacagtacagattag

SEQ ID NO: 8431 - DNA, 1402 bp, synthetic construct
  misc_feature 1..1402: note = Synthetic polypeptide
  source 1..1402: mol_type = other DNA
tttcttggttccctgactgggaagcgaggtgattaacagacaatcgaggcagcccttaggcagcttaggcccgccctgtggagcatccctgcgggggactccggccagcttgagcgacacggatcctgagagcactcccatgtaggcaattgccccagtggaatgcctcgccagagcagtgcatggcaggcccttgtggaggatcaacacagcggctgaacaccaggaaggacatggcacttggagtctggacatctgaaacttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaagggggtgtcctggtcaatgaaatcctcaatcacatgaagagagcaactcagataccaagctacaaaaaactcatcatgtattctgcgcatgacactactgtgagtggcctacagatggcgctagatgtttacaacggactccttcctccctatgcttcttgccacttgacggaattgtactttgagaagggggagtactttgtggagatgtactatcggaatgagacgcagcacgagccgtatcccctcatgctacctggctgcagccccagctgtcctctggagaggtttgctgagctggttggccctgtgatccctcaagactggtccacggagtgtatgaccacaaacagccatcaagttctaaaggtcatctttgctgttgccttttgcctgatatctgctgtcctaatggtactactgtttatccacattcgccgtggactctgctggcagagagaatcctatgggaacatctga

SEQ ID NO: 8432 - DNA, 2636 bp, synthetic construct
  misc_feature 1..2636: note = Synthetic polypeptide
  source 1..2636: mol_type = other DNA
gcctaaaggaacattttgacaccactaagcagaccaacatacacattatagaagtaccagaaggaaaatagaaaggagcagagagaatatatatttgatcaaataatggctgaaaatttcccaaatttgatgaaagacaggagtataaacatccaaacagctcaatgaactccaagtaagatgaactcagagaccctcaccaagacacattataatcaaactttcaaaagccaaagacaaactcttgaaagcatcaagagagaaatgactaaatgattcattacataaaggtatcctcagtaaaattatgaacgaatttctcatcagaaactttggaggccaggaggcagtgagccagtgtattcaaagtgctaaaaggaaaacaaaacaaaactgtcaaccaagcatcctatatctggcaaaactgtccttcaaaaggggcgagagattaagacattctcagaaaaacaaaagctaaggaaacttgttaccactggacctgccttgtaagaaatgctcaggagagtctgcaaggtgaaatgaaaggacattagattgtaacttgaagccatatgaagaaatatctcgataaagggagtcgtcgcatggtggatgtcatggacgtgaacacacagaaaggcattgaaatgaccatggctcagtggacacgctactatgagaccccagaggaggagcgagagaaactctataatgtcatcagcctcgagtttagccacaccaggctggagaatatggtgcagaggccctccacggtggatttcattgactgggtagacaacatgtggccaaggcacttgaaggaaagccagactgaatcaacaaatgccatcttggagatgcagtaccctaaagtgcagaagtactgtctaatgagtgttcgaggctgctatactgacttccatgtggactttggtggtacctctgtttggtatcacatccatcaagggggaaaggtcttctggctcatcccccctacagcccacaacctggagctgtacgagaattggctgctgtcagggaaacagggagacatctttctgggtgaccgggtatcagattgtcagcgcattgagctcaagcagggctataccttcgtcattccctcaggctggattcatgctgtgtatactcctacagacacattagtgtttgggggcaattttttgcatagcttcaacatccctatgcagttaaaaatatacaacattgaagatcggacacgggttccaaataagtttcgctatccattctactatgagatgtgttggtatgtgttggagcgctatgtgtactgcataaccaaccgttcccacctaactaaggaatttcagaaagagtccctcagcatggatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcacccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtgctgcgacaagagactttggacaaaaattga

SEQ ID NO: 8433 - DNA, 3776 bp, synthetic construct
  misc_feature 1..3776: note = Synthetic polypeptide
  source 1..3776: mol_type = other DNA
gcctaaaggaacattttgacaccactaagcagaccaacatacacattatagaagtaccagaaggaaaatagaaaggagcagagagaatatatatttgatcaaataatggctgaaaatttcccaaatttgatgaaagacaggagtataaacatccaaacagctcaatgaactccaagtaagatgaactcagagaccctcaccaagacacattataatcaaactttcaaaagccaaagacaaactcttgaaagcatcaagagagaaatgactaaatgattcattacataaaggtatcctcagtaaaattatgaacgaatttctcatcagaaactttggaggccaggaggcagtgagccagtgtattcaaagtgctaaaaggaaaacaaaacaaaactgtcaaccaagcatcctatatctggcaaaactgtccttcaaaaggggcgagagattaagacattctcagaaaaacaaaagctaaggaaacttgttaccactggacctgccttgtaagaaatgctcaggagagtctgcaaggtgaaatgaaaggacattagattgtaacttgaagccatatgaagaaatatctcgataaagggagtcgtcgcatggtggatgtcatggacgtgaacacacagaaaggcattgaaatgaccatggctcagtggacacgctactatgagaccccagaggaggagcgagagaaactctataatgtcatcagcctcgagtttagccacaccaggctggagaatatggtgcagaggccctccacggtggatttcattgactgggtagacaacatgtggccaaggcacttgaaggaaagccagactgaatcaacaaatgccatcttggagatgcagtaccctaaagtgcagaagtactgtctaatgagtgttcgaggctgctatactgacttccatgtggactttggtggtacctctgtttggtatcacatccatcaagggggaaaggtcttctggctcatcccccctacagcccacaacctggagctgtacgagaattggctgctgtcagggaaacagggagacatctttctgggtgaccgggtatcagattgtcagcgcattgagctcaagcagggctataccttcgtcattccctcaggctggattcatgctgtgtatactcctacagacacattagtgtttgggggcaattttttgcatagcttcaacatccctatgcagttaaaaatatacaacattgaagatcggacacgggttccaaataagtttcgctatccattctactatgagatgtgttggtatgtgttggagcgctatgtgtactgcataaccaaccgttcccacctaactaaggaatttcagaaagagtccctcagcatggatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcacccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctgcaggccatcacggcctcctctgccaaccttcgccattccccccgtgtgctagtgcagcactgcccagcccgaaccccccagcgtggggatgaggaggggctggggggagaggaggaggaagaggaggaggaggaggaggaagatgacagtgcagaggaggggggtgcagccaggctgaatggccggggcagttgggctcaggatggagacgaaagctggatgcagcgggaggtctggatgtctgtcttccgctacctcagccgcagagaactttgtgaatgtatgcgagtgtgcaagacgtggtataaatggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaa

SEQ ID NO: 8434 - DNA, 331 bp, synthetic construct
  misc_feature 1..331: note = Synthetic polypeptide
  source 1..331: mol_type = other DNA
cggcgcggcgcggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgc

SEQ ID NO: 8435 - DNA, 1538 bp, synthetic construct
  misc_feature 1..1538: note = Synthetic polypeptide
  source 1..1538: mol_type = other DNA
cggcgcggcgcggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctga

SEQ ID NO: 8436 - DNA, 884 bp, synthetic construct
  misc_feature 1..884: note = Synthetic polypeptide
  source 1..884: mol_type = other DNA
cggcgcggcgcggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctga

SEQ ID NO: 8437 - DNA, 343 bp, synthetic construct
  misc_feature 1..343: note = Synthetic polypeptide
  source 1..343: mol_type = other DNA
cggcgcggcgcggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgca

SEQ ID NO: 8438 - DNA, 401 bp, synthetic construct
  misc_feature 1..401: note = Synthetic polypeptide
  source 1..401: mol_type = other DNA
cggcgcggcgcggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcgg

SEQ ID NO: 8439 - DNA, 1535 bp, synthetic construct
  misc_feature 1..1535: note = Synthetic polypeptide
  source 1..1535: mol_type = other DNA
cggcgcggcgcggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaaggtaaagacacctgggcttga

SEQ ID NO: 8440 - DNA, 255 bp, synthetic construct
  misc_feature 1..255: note = Synthetic polypeptide
  source 1..255: mol_type = other DNA
cggcgcggcgcggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctga

SEQ ID NO: 8441 - DNA, 88 bp, synthetic construct
  misc_feature 1..88: note = Synthetic polypeptide
  source 1..88: mol_type = other DNA
cggcgcggcgcggagccctggaggtccaggtccctgaagacccagtggtggcactggtgggcaccgatgccaccctgtgctgctcctt

SEQ ID NO: 8442 - DNA, 429 bp, synthetic construct
  misc_feature 1..429: note = Synthetic polypeptide
  source 1..429: mol_type = other DNA
cggcgcggcgcggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgct

SEQ ID NO: 8443 - DNA, 487 bp, synthetic construct
  misc_feature 1..487: note = Synthetic polypeptide
  source 1..487: mol_type = other DNA
ggctgggtacagtggctaatgcctgtaatcccagcactttgggaggccgtgaagatctcaagatctcttgaggccagaagttcgagaccagcctggccaacatggcaaaacccccatctctactaaaaatacaaaaaattagccggacatggtgaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaa

SEQ ID NO: 8444 - DNA, 466 bp, synthetic construct
  misc_feature 1..466: note = Synthetic polypeptide
  source 1..466: mol_type = other DNA
ggctgggtacagtggctaatgcctgtaatcccagcactttgggaggccgtgaagatctcaagatctcttgaggccagaagttcgagaccagcctggccaacatggcaaaacccccatctctactaaaaatacaaaaaattagccggacatggtgaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggtaataggtcaacattttatcatggaaaggttcagccacagtgagagtggattttag

SEQ ID NO: 8445 - DNA, 610 bp, synthetic construct
  misc_feature 1..610: note = Synthetic polypeptide
  source 1..610: mol_type = other DNA
gtcaggtgcggtggctcatgcctttaatcctaacattttgggcggctgatgcgggtggatcacttgaggttgggagttcgagaccagcctggccaacctcgtctggccagtgaatggtggtgaaacctcgtctctactgaaaatacaaaaattagccaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaagaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaaca

SEQ ID NO: 8446 - DNA, 1047 bp, synthetic construct
  misc_feature 1..1047: note = Synthetic polypeptide
  source 1..1047: mol_type = other DNA
gtcaggtgcggtggctcatgcctttaatcctaacattttgggcggctgatgcgggtggatcacttgaggttgggagttcgagaccagcctggccaacctcgtctggccagtgaatggtggtgaaacctcgtctctactgaaaatacaaaaattagccaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaagaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaa

SEQ ID NO: 8447 - DNA, 1005 bp, synthetic construct
  misc_feature 1..1005: note = Synthetic polypeptide
  source 1..1005: mol_type = other DNA
gactgggcctggtggctcacgccggtaatcccagcactttgggaggccgaggcgggtggatcacgacatcaggagatcgagaccatcctggctaagacggtacaccagaggatcgcttcctggcagaatttgggagctgtttattgcagcactgttgtgccctctgatgatgttacagtggtttatcaaaatgggttacctgtgatatctgtgaggctaccatcccggcgtgaacgctgtcagttcacactcaagcctatctctgactctgttggtgtatttttacgacaactgcaagaagaggatcggggaattgacagagttgctatctattcaccagatggtgttcgcgttgctgcttcaacaggaatagacctcctcctccttgatgactttaagctggtcattaatgacttaacataccacgtacgaccaccaaaaagagacctcttaagtcatgaaaatgcagcaacgctgaatgatgtaaagacattggtccagcaactatacaccacactgtgcattgagcagcaccagttaaacaaggaaagggagcttattgaaagactagaggatctcaaagagcagctggctcccctggaaaaggtacgaattgagattagcagaaaagctgagaagaggaccactttggtgctatggggtggccttgcctacatggccacacagtttggcattttggcccggcttacctggtgggaatattcctgggacatcatggagccagtaacatacttcatcacttatggaagtgccatggcaatgtatgcatattttgtaatgacacgccaggaatatgtttatccagaagccagagacagacaatacttactatttttccataaaggagccaaaaagtcacgttttgacctagagaaatacaatcaactcaaggatgcaattgctcaggcagaaatggaccttaagagactgagagacccattacaagtacatctgcctctccgacaaattggtgaaaaagattga

SEQ ID NO: 8448 - DNA, 942 bp, synthetic construct
  misc_feature 1..942: note = Synthetic polypeptide
  source 1..942: mol_type = other DNA
gactgggcctggtggctcacgccggtaatcccagcactttgggaggccgaggcgggtggatcacgacatcaggagatcgagaccatcctggctaagacggtacaccagaggatcgcttcctggcagaatttgggagctgtttattgcagcactgttgtgccctctgatgatgttacagtggtttatcaaaatgggttacctgtgatatctgtgaggctaccatcccggcgtgaacgctgtcagttcacactcaagcctatctctgactctgttggtgtatttttacgacaactgcaagaagaggatcggggaattgacagagttgctatctattcaccagatggtgttcgcgttgctgcttcaacaggaatagacctcctcctccttgatgactttaagctggtcattaatgacttaacataccacgtacgaccaccaaaaagagtagagatggggttttgccatgttggccagaatggttttgaactcctgacctcaagttatctacctgcctcagcctcccaaagtgccgagattatagccgtacgaattgagattagcagaaaagctgagaagaggaccactttggtgctatggggtggccttgcctacatggccacacagtttggcattttggcccggcttacctggtgggaatattcctgggacatcatggagccagtaacatacttcatcacttatggaagtgccatggcaatgtatgcatattttgtaatgacacgccaggaatatgtttatccagaagccagagacagacaatacttactatttttccataaaggagccaaaaagtcacgttttgacctagagaaatacaatcaactcaaggatgcaattgctcaggcagaaatggaccttaagagactgagagacccattacaagtacatctgcctctccgacaaattggtgaaaaagattga

SEQ ID NO: 8449 - DNA, 559 bp, synthetic construct
  misc_feature 1..559: note = Synthetic polypeptide
  source 1..559: mol_type = other DNA
gactgggcctggtggctcacgccggtaatcccagcactttgggaggccgaggcgggtggatcacgacatcaggagatcgagaccatcctggctaagacggtacaccagaggatcgcttcctggcagaatttgggagctgtttattgcagcactgttgtgccctctgatggtgaatgttacagtggtttatcaaaatgggttacctgtgatatctgtgaggctaccatcccggcgtgaacgctgtcagttcacactcaagcctatctctgactctgttggtgtatttttacgacaactgcaagaagaggatcggggaattgacagagttgctatctattcaccagatggtgttcgcgttgctgcttcaacaggaatagacctcctcctccttgatgactttaagctggtcattaatgacttaacataccacgtacgaccaccaaaaagagacctcttaagtcatgaaaatgcagcaacgctgaatgatgtaaagacattggtccagcaactatacaccacactgtgcattgagcagcaccagttaaacaaggaaagggag

SEQ ID NO: 8450 - DNA, 4522 bp, synthetic construct
  misc_feature 1..4522: note = Synthetic polypeptide
  source 1..4522: mol_type = other DNA
ctccccctccctccctccccctctccctctccctctccccacggtctccctctgcctctctttccacggtctccctctgatgccgagccgaagctggactgtactgccgccatctctgctcactgcaacctccctgcctgattctcctgcctcaacctgccgagtgcctgcaattgcaggcacgcgccgccacgcctgactggttttcgtatttttttggtggagacggggtttcgctgtgttggccaggcaggtctctagctcctaaccgggagtaatctgccagcctcagcctcccgaggtgccgggattgcagatggagtcttgttcactcagtgctcaatgttgcccaggctggagtgcagcggcgtgatcttggctcactacaacctccacctcccagccgcctgccttggcctcccaaagtgccgagattgcagcctctgcctggccgccaccccatctgggaagtgaggagcgtctctgcctggccgcccatcgtctgggatgtgaggagcccctctgcccggctgcccagtctgggaagtgaggagcgcctcttcccggccgccatcccgtctaggaagtgaggagcgtctctgcccggccgcccatcgtctgagatgtggggagcgcctctgccccgccaccccatctgggatgtgaggagcgcctctgcccggccgcgaccccgtctgggagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacaacaaacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaa

SEQ ID NO: 8451 - DNA, 278 bp, synthetic construct
  misc_feature 1..278: note = Synthetic polypeptide
  source 1..278: mol_type = other DNA
agaaggcggactctggagccagaccgtctggatttgaacgcggattcggccacttactagttccgtgatcttgggaggacccagacagcgtgccccccatcgatgtcctctggatcaaaggggcccagggaggtgactacttctactcctttgggggctgccaccgctacgcggcctaccagcaactgcagcgagagaccatccccgccaagcttgtccagtccactctctcagacctaagggtgtacctgggagcatccacaccagacttgcagtag

SEQ ID NO: 8452 - DNA, 136 bp, synthetic construct
  misc_feature 1..136: note = Synthetic polypeptide
  source 1..136: mol_type = other DNA
agaaggcggactctggagccagaccgtctggatttgaacgcggattcggccacttactagttccgtgatcttgggaggacccagacagcgtgccccccatcgatgtcctctggatcaaaggggcccagggaggtga

SEQ ID NO: 8453 - DNA, 2265 bp, synthetic construct
  misc_feature 1..2265: note = Synthetic polypeptide
  source 1..2265: mol_type = other DNA
ggccgggcgcaatgcctcatgcctgtaatcccagcactttgggaggccgaggcgggcagatcacaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattag

SEQ ID NO: 8454 - DNA, 2121 bp, synthetic construct
  misc_feature 1..2121: note = Synthetic polypeptide
  source 1..2121: mol_type = other DNA
ggccgggcgcaatgcctcatgcctgtaatcccagcactttgggaggccgaggcgggcagatcacaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttccacctggagatcctttcacaccgagcggaagacagaaccagccacaggtttcatcgacggtga

SEQ ID NO: 8455 - DNA, 705 bp, synthetic construct
  misc_feature 1..705: note = Synthetic polypeptide
  source 1..705: mol_type = other DNA
ggccgggcgcaatgcctcatgcctgtaatcccagcactttgggaggccgaggcgggcagatcacaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggt

SEQ ID NO: 8456 - DNA, 595 bp, synthetic construct
  misc_feature 1..595: note = Synthetic polypeptide
  source 1..595: mol_type = other DNA
ggccgggcgcaatgcctcatgcctgtaatcccagcactttgggaggccgaggcgggcagatcacaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggag

SEQ ID NO: 8457 - DNA, 256 bp, synthetic construct
  misc_feature 1..256: note = Synthetic polypeptide
  source 1..256: mol_type = other DNA
ggccgggcgcaatgcctcatgcctgtaatcccagcactttgggaggccgaggcgggcagatcacaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccaggtga

SEQ ID NO: 8458 - DNA, 1007 bp, synthetic construct; identical to SEQ ID NO: 7489
  misc_feature 1..1007: note = Synthetic polypeptide
  source 1..1007: mol_type = other DNA

SEQ ID NO: 8459 - DNA, 2261 bp, synthetic construct
  misc_feature 1..2261: note = Synthetic polypeptide
  source 1..2261: mol_type = other DNA
ggccgggcgcggtggctcacggctgtaatcccagcactttgggaggccgaggcgggcggatcatgaggtcaggagatcgagaccatcctggctaacaagaaggccccctgctgaggccggctggccggaggaccaccccgcagaccacgcgcccggggcctggcaccgagagggaggccccgatcagcaggcggaggcgacaccctgatgacgctggccagttcgccgtcgctctggtcatcatttaccgcaccctggggcagctcctgcccgagcgctacgaccccgaccgtcgcagcctccggttgcctcaccggcccatcattaataccccgatggtgagcacgctggtgtacagcgagggggctccgctcccgagacccctggagaggcccgtcctggtggagttcgccctgctggaggtggaggagcgaaccaagcctgtctgcgtgttctggaaccactccctggccgttggtgggacgggagggtggtctgcccggggctgcgagctcctgtccaggaaccggacacatgtcgcctgccagtgcagccacacagccagctttgcggtgctcatggatatctccaggcgtgagaacggggaggtcctgcctctgaagattgtcacctatgccgctgtgtccttgtcactggcagccctgctggtggccttcgtcctcctgagcctggtccgcatgctgcgctccaacctgcacagcattcacaagcacctcgccgtggcgctcttcctctctcagctggtgttcgtgattgggatcaaccagacggaaaacccgtttctgtgcacagtggttgccatcctcctccactacatctacatgagcacctttgcctggaccctcgtggagagcctgcatgtctaccgcatgctgaccgaggtgcgcaacatcgacacggggcccatgcggttctactacgtcgtgggctggggcatcccggccattgtcacaggactggcggtcggcctggacccccagggctacgggaaccccgacttctgctggctgtcgcttcaagacaccctgatttggagctttgcggggcccatcggagctgttataatcatcaacacagtcacttctgtcctatctgcaaaggtttcctgccaaagaaagcaccattattatgggaaaaaagggatcgtctccctgctgaggaccgcattcctcctgctgctgctcatcagcgccacctggctgctggggctgctggctgtgaaccgcgatgcactgagctttcactacctcttcgccatcttcagcggcttacagggccccttcgtcctccttttccactgcgtgctcaaccaggaggtccggaagcacctgaagggcgtgctcggcgggaggaagctgcacctggaggactccgccaccaccagggccaccctgctgacgcgctccctcaactgcaacaccaccttcggtgacgggcctgacatgctgcgcacagacttgggcgagtccaccgcctcgctggacagcatcgtcagggatgaagggatccagaagctcggcgtgtcctctgggctggtgaggggcagccacggagagccagacgcgtccctcatgcccaggagctgcaaggatccccctggccacgattccgactcagatagcgagctgtccctggatgagcagagcagctcttacgcctcctcacactcgtcagacagcgaggacgatggggtgggagctgaggaaaaatgggacccggccaggggcgccgtccacagcacccccaaaggggacgctgtggccaaccacgttccggccggctggcccgaccagagcctggctgagagtgacagtgaggaccccagcggcaagccccgcctgaaggtggagaccaaggtcagcgtggagctgcaccgcgaggagcagggcagtcaccgtggagagtaccccccggaccaggagagcgggggcgcagccaggcttgctagcagccagcccccagagcagaggaaaggcatcttgaaaaataaagtcacctacccgccgccgctgacgctgacggagcagacgctgaagggccggctccgggagaagctggccgactgtgagcagagccccacatcctcgcgcacgtcttccctgggctctggcggccccgactgcgccatcacagtcaagagccctgggagggagccggggcgtgaccacctcaacggggtggccatgaatgtgcgcactgggagcgcccaggccgatggctccgactctgagaaaccgtga

SEQ ID NO: 8460 - DNA, 1211 bp, synthetic construct; identical to SEQ ID NO: 526
  misc_feature 1..1211: note = Synthetic polypeptide
  source 1..1211: mol_type = other DNA

SEQ ID NO: 8461 - DNA, 1133 bp, synthetic construct; identical to SEQ ID NO: 527
  misc_feature 1..1133: note = Synthetic polypeptide
  source 1..1133: mol_type = other DNA

SEQ ID NO: 8462 - DNA, 841 bp, synthetic construct; identical to SEQ ID NO: 529
  misc_feature 1..841: note = Synthetic polypeptide
  source 1..841: mol_type = other DNA

SEQ ID NO: 8463 - DNA, 659 bp, synthetic construct; identical to SEQ ID NO: 530
  misc_feature 1..659: note = Synthetic polypeptide
  source 1..659: mol_type = other DNA

SEQ ID NO: 8464 - DNA, 607 bp, synthetic construct
  misc_feature 1..607: note = Synthetic polypeptide
  source 1..607: mol_type = other DNA
ggccaggtgcggtggctcgcgcttacattcctagcactttgggaggccaaggcgggcggatcacctgaggtcaggcgttggagaccagcctagccaacatgatgaaacctcgtctctactaaaaatacaaaaaattagctgggcgtggtggtgcgtgcttgtagtcccagacactccggaggtgaggcgggagaatcgcttgagcccgggaggtggaggttgcagtaagccaacaccgtgccactgcactacagcctgggcgacaggggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaagtgtgcccagctggctggaaacctggcagtgataccatcaagcctgatgtccaaaagagcaaagaatatttctccaagcagaagtga

SEQ ID NO: 8465 - DNA, 521 bp, synthetic construct
  misc_feature 1..521: note = Synthetic polypeptide
  source 1..521: mol_type = other DNA
ggccaggtgcggtggctcgcgcttacattcctagcactttgggaggccaaggcgggcggatcacctgaggtcaggcgttggagaccagcctagccaacatgatgaaacctcgtctctactaaaaatacaaaaaattagctgggcgtggtggtgcgtgcttgtagtcccagacactccggaggtgaggcgggagaatcgcttgagcccgggaggtggaggttgcagtaagccaacaccgtgccactgcactacagcctgggcgacaggggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaag

SEQ ID NO: 8466 - DNA, 7177 bp, synthetic construct; identical to SEQ ID NO: 574
  misc_feature 1..7177: note = Synthetic polypeptide
  source 1..7177: mol_type = other DNA

SEQ ID NO: 8467 - DNA, 7195 bp, synthetic construct; identical to SEQ ID NO: 575
  misc_feature 1..7195: note = Synthetic polypeptide
  source 1..7195: mol_type = other DNA

SEQ ID NO: 8468 - DNA, 355 bp, synthetic construct
  misc_feature 1..355: note = Synthetic polypeptide
  source 1..355: mol_type = other DNA
ccttgctattcagagcatggtttggagccaatggcatcagcatcacctatgaatgcagaatctcaggctgttccccagatctactgaaacagaatttttacttcaacaagatcttcagtcccaacctccctactacaatgtgacagccatgaatgtaccaattgcagtgtggaacggtggcaaggacctgttggctgacccccaagatgttggccttttgcttccaaaactccccaatcttatttaccacaaggagattcctttttacaatcacttggactttatctgggcaatggatgcccctcaagaagtttacaatgacattgtttctatgatatcagaagataaaaagtag

SEQ ID NO: 8469 - DNA, 1227 bp, synthetic construct
  misc_feature 1..1227: note = Synthetic polypeptide
  source 1..1227: mol_type = other DNA
ttatgataccacactgctcaaaaactcttagtgacttcttataatttataggttgcagttcaaatttgttagtcttggaatgtaaaggtctcttaaattgagccccagcctaccttcccagcattataggttactattatcctgctccagatccctagccaaactgggctcctccctgacctccagcagggatttccccttctacctcatgaaatctacagcaaccaacgctgcaaggaacatttaaattcttacttccttcaagaagtcttcccggatcacctccaactcaaggaaaaagaaaagaagtacatgcttcccttggacaacctgaaagttcgggatgtggaaaagagctttatgtctagcaagcacatctttgcactctttaatacagagcaaaggaatgtatacaaagactatcgcttccttgagctggcatgtgattcccaggaggatgtcgacagctggaaggcatctctactaagagctggggtctatcctgacaaatctgtagggaacaacaaagctgaaaatgatgagaatggacaagcagaaaacttttccatggacccacaattggagaggcaagtggagaccattcgcaacctcgtagactcctacatgtccattatcaacaaatgtatccgagatctaattccaaaaacaataatgcaccttatgatcaataacgttaaagatttcataaattccgagctcctagcacagttgtattcttcagaggaccaaaataccctgatggaggaatctgctgagcaggctcagcgccgggatgagatgcttcgaatgtatcaagcactgaaagaagcccttgggataattggggacatcagcacagccaccgtgtccactccggcaccccctccagtggatgactcctggatacagcactctcgcaggtcacctcctccaagccccacaacccaaaggaggccaacactaagtgctcccctcgcaaggcccacatccggccgaggaccagctcctgccattccctctcctggcccccactctggggctcctccagtcccattccgtccaggcccattacctcctttccccagcagcagtgactccttcggagcccctccacaagttccatctaggcctacgagggccccgcccagtgtcccaagccggagaccacccccatcaccaactcgtcccactataatccgcccactagaatcctccctgttagactaa

SEQ ID NO: 8470 - DNA, 1215 bp, synthetic construct
  misc_feature 1..1215: note = Synthetic polypeptide
  source 1..1215: mol_type = other DNA
ttatgataccacactgctcaaaaactcttagtgacttcttataatttataggttgcagttcaaatttgttagtcttggaatgtaaaggtctcttaaattgagccccagcctaccttcccagcattataggttactattatcctgctccagatccctagccaaactgggctcctccctgacctccagcagggatttccccttctacctcatgaaatctacagcaaccaacgctgcaaggaacatttaaattcttacttccttcaagaagtcttcccggatcacctccaactcaaggaaaaagaaaagaagtacatgcttcccttggacaacctgaaagttcgggatgtggaaaagagctttatgtctagcaagcacatctttgcactctttaatacagagcaaaggaatgtatacaaagactatcgcttccttgagctggcatgtgattcccaggaggatgtcgacagctggaaggcatctctactaagagctggggtctatcctgacaaatctgtagctgaaaatgatgagaatggacaagcagaaaacttttccatggacccacaattggagaggcaagtggagaccattcgcaacctcgtagactcctacatgtccattatcaacaaatgtatccgagatctaattccaaaaacaataatgcaccttatgatcaataacgttaaagatttcataaattccgagctcctagcacagttgtattcttcagaggaccaaaataccctgatggaggaatctgctgagcaggctcagcgccgggatgagatgcttcgaatgtatcaagcactgaaagaagcccttgggataattggggacatcagcacagccaccgtgtccactccggcaccccctccagtggatgactcctggatacagcactctcgcaggtcacctcctccaagccccacaacccaaaggaggccaacactaagtgctcccctcgcaaggcccacatccggccgaggaccagctcctgccattccctctcctggcccccactctggggctcctccagtcccattccgtccaggcccattacctcctttccccagcagcagtgactccttcggagcccctccacaagttccatctaggcctacgagggccccgcccagtgtcccaagccggagaccacccccatcaccaactcgtcccactataatccgcccactagaatcctccctgttagactaa

SEQ ID NO: 8471 - DNA, 555 bp, synthetic construct
  misc_feature 1..555: note = Synthetic polypeptide
  source 1..555: mol_type = other DNA
ttatgataccacactgctcaaaaactcttagtgacttcttataatttataggttgcagttcaaatttgttagtcttggaatgtaaaggtctcttaaattgagccccagcctaccttcccagcattataggttactattatcctgctccagatccctagccaaactgggctcctccctgacctccagcagggatttccccttctacctcatgaaatctacagcaaccaacgctgcaaggaacatttaaattcttacttccttcaagaagtcttcccggatcacctccaactcaaggaaaaagaaaagaagtacatgcttcccttggacaacctgaaagttcgggatgtggaaaagagctttatgtctagcaagcacatctttgcactctttaatacagagcaaaggaatgtatacaaagactatcgcttccttgagctggcatgtgattcccaggaggatgtcgacagctggaaggcatctctactaagagctggggtctatcctgacaaatctgtagtaagttggatatatctcttatgtaaaaattattattag

SEQ ID NO: 8472 - DNA, 300 bp, synthetic construct
  misc_feature 1..300: note = Synthetic polypeptide
  source 1..300: mol_type = other DNA
ttatgataccacactgctcaaaaactcttagtgacttcttataatttataggttgcagttcaaatttgttagtcttggaatgtaaaggtctcttaaattgagccccagcctaccttcccagcattataggttactattatcctgctccagatccctagccaaactgggctcctccctgacctccagcagggatttccccttctacctcatgaaatctacagcaaccaacgctgcaaggaacatttaaattcttacttccttcaagaagtcttcccggatcacctccaactcaaggaaaaa

SEQ ID NO: 8473 - DNA, 2662 bp, synthetic construct
  misc_feature 1..2662: note = Synthetic polypeptide
  source 1..2662: mol_type = other DNA
ggaaggcagagcaagatggctgaatagaaccctccagcatttgtcccccaagcaagaacaccaacttgaacaactatccacacaagaaagcactttcagaagaactaaaactcaggacttcattgacttaactagagagaccagaccaaggacaaaagatcgcagtggactgtatgtgattgacctgacaagagctgagggagaaaatagacctattgccactcttgacttaactttagaacctgtcactccttcccagaaggagccaaccagtcttcagacatgtgccagcctctctggcaaagcggtgatggaagggcacgtggacagaagctctcagcctacagcacggagaatcattaacagtgatcctgtagatttggacctagtggaagaaaacacctttgtaggtcccccacccgctacatccatcagtggaggctctgtttatccaacagagcctaattgtagctcagccacattcacaggtaacctcagcttcttggcaagtctacagctgtcttcagatgttagctccctctccccaacaagcaataatagtaggagcagcagcagcagcagcaatcaaaaagcacccttgccatgcccacagcaagatgtatctcgcccaccacaggccttgccgtgccccctgcgacctttgccatgcccaccgagagcctcaccatgtccaccacgagcctcctcatgcccaccacgagccttgtcatgcccatcacaaaccatgcagtgccaactaccagctctaactcacccacctcaagaagtgccatgccctcggcagaatatcccaggcccacctcaagactctctgggcctacctcaagatgtgccagggctgcctcaaagcatattacatccacaagatgtggcatacctgcaagacatgccacggtcaccaggagatgtgccacagtcaccaagtgatgtttcaccgtcaccagatgcaccacagtcaccagggggcatgccacacttaccgggagatgtgttacattcacctggagacatgccacactcatcaggggacgtgacacactcacctagagacatccctcacttaccaggagacaggcctgactttacccagaatgatgtacagaaccgtgacatgcctatggatatctcagctctgtcctctccaagctgctctcccagcccacagtctgaaactcccttagagaaagttccttggctctctgtcatggaaaccccagccagaaaagaaatatcactgtcagagcctgccaaacctgggtctgcccacgtacaatcacgaacaccacaaggtgggttgtacaacagaccatgcctgcatagactgaagtacttcttacgtcctccggttcatcacctcttctttcagacgctaataccggataaagacacaagagagaacaagggtcaaaaattagaacccatccctcatcgaagactaagaatggtaacaaataccattgaagagaattttcctctggggactgtgcagtttttgatggactttgtgtcaccccagcattacccaccaagagaaatcgtggctcacatcatccagaaaatcttgctcagtggctctgagactgtggatgtcctaaaggaggcctacatgcttctcatgaaaattcaacagctacatccagccaatgccaagacagtggagtgggactggaaactgctcacctatgtcatggaggaagagggacaaactctgcctgggcgagtccttttcctgcgttatgtcgttcagaccctagaagatgactttcagcagaccctgaggaggcaacggcagcacctgcagcaatccattgcaaacatggtgctttcctgtgacaagcagccccacaatgtcagggatgttatcaagtggctggtcaaagcagtaactgaagatggattgactcagcccccaaatggaaatcaaacgtcttcaggaacaggaatcttgaaagccagcagtagccacccttcttcccagcccaacctgacaaagaacaccaatcagctgattgtgtgccagcttcagaggatgctctccatagccgtagaggtggacaggacccccacctgcagctccaataaaattgccgagatgatgtttgggtttgtgctggacattcctgagaggagccagagagaaatgttctttactaccatggaaagccaccttctgcgctgcaaagtgttagaaatcatattcctccacagctgtgagacacccacccgcctgcctctgtctctggcccaggccctctactttctgaataattctacgtcactgctcaagtgtcagtcagataaaagccagtggcagacttgggacgaattggttgagcatctgcagtttctgctgtccagttatcaacatgttttaagagaacacttaaggagttccgtgatcgaccgaaaggacttaataatcaaaaggattaagcccaaaccccagcaaggagatgacatcacagtggtagacgtagagaagcagattgaggccttccgcagccgcctgatccagatgctgggggagcctcttgtcccccaactccaagacaaagtgcacttgttgaagctcctgctcttctatgctgcggacttgaaccctgatgcagagccctttcaaaagggctggagcggctcctga

SEQ ID NO: 8474 - DNA, 1822 bp, synthetic construct
  misc_feature 1..1822: note = Synthetic polypeptide
  source 1..1822: mol_type = other DNA
ggaaggcagagcaagatggctgaatagaaccctccagcatttgtcccccaagcaagaacaccaacttgaacaactatccacacaagaaagcactttcagaagaactaaaactcaggacttcattgacttaactagagagaccagaccaaggacaaaagatcgcagtggactgtatgtgattgacctgacaagagctgagggagaaaatagacctattgccactcttgacttaactttagaacctgtcactccttcccagaaggagccaaccagtcttcagacatgtgccagcctctctggcaaagcggtgatggaagggcacgtggacagaagctctcagcctacagcacggagaatcattaacagtgatcctgtagatttggacctagtggaagaaaacacctttgtaggtcccccacccgctacatccatcagtggaggctctgtttatccaacagagcctaattgtagctcagccacattcacaggtaacctcagcttcttggcaagtctacagctgtcttcagatgttagctccctctccccaacaagcaataatagtaggagcagcagcagcagcagcaatcaaaaagcacccttgccatgcccacagcaagatgtatctcgcccaccacaggccttgccgtgccccctgcgacctttgccatgcccaccgagagcctcaccatgtccaccacgagcctcctcatgcccaccacgagccttgtcatgcccatcacaaaccatgcagtgccaactaccagctctaactcacccacctcaagaagtgccatgccctcggcagaatatcccaggcccacctcaagactctctgggcctacctcaagatgtgccagggctgcctcaaagcatattacatccacaagatgtggcatacctgcaagacatgccacggtcaccaggagatgtgccacagtcaccaagtgatgtttcaccgtcaccagatgcaccacagtcaccagggggcatgccacacttaccgggagatgtgttacattcacctggagacatgccacactcatcaggggacgtgacacactcacctagagacatccctcacttaccaggagacaggcctgactttacccagaatgatgtacagaaccgtgacatgcctatggatatctcagctctgtcctctccaagctgctctcccagcccacagtctgaaactcccttagagaaagttccttggctctctgtcatggaaaccccagccagaaaagaaatatcactgtcagagcctgccaaacctgggtctgcccacgtacaatcacgaacaccacaaggtgggttgtacaacagaccatgcctgcatagactgaagtacttcttacgtcctccggttcatcacctcttctttcagacgctaataccggataaagacacaagagagaacaagggtcaaaaattagaacccatccctcatcgaagactaagaatggtaacaaataccattgaagagaattttcctctggggactgtgcagtttttgatggactttgtgtcaccccagcattacccaccaagagaaatcgtggctcacatcatccagaaaatcttgctcagtggctctgagactgtggatgtcctaaaggaggcctacatgcttctcatgaaaattcaacagctacatccagccaatgccaagacagtggagtgggactggaaactgctcacctatgtcatggaggaagagcctgccgagtgcctgcgattgcaggcacgcgccaccacgcctgactggttttggtggagacggggtttcgctgtgttggccgggccggtctccagcccctaa

SEQ ID NO: 8475 - DNA, 2747 bp, synthetic construct
  misc_feature 1..2747: note = Synthetic polypeptide
  source 1..2747: mol_type = other DNA
caggttgagcatccttaattcaaaaatccaaaattggaaatgctccagaatctgaaactttttgagcactgatacgttgctcagaggtcatgctcggaggaaatgctcgttggagcactttggattttggattttcagattgggaatccttaactgctctttgccgagggcgtgtggtgagagtccccacagcgaccctggttcgagtggtgggcactgagctggtcatcccctgcaacgtcagtgactatgatggccccagcgagcaaaactttgactggagcttctcatctttggggagcagctttgtggagcttgcaagcacctgggaggtggggttcccagcccagctgtaccaggagcggctgcagaggggcgagatcctgttaaggcggactgccaacgacgccgtggagctccacataaagaacgtccagccttcagaccaaggccactacaaatgttcaacccccagcacagatgccactgtccagggaaactatgaggacacagtgcaggttaaagtgctggccgactccctgcacgtgggccccagcgcgcggcccccgccgagcctgagcctgcgggagggggagcccttcgagctgcgctgcaccgccgcctccgcctcgccgctgcacacgcacctggcgctgctgtgggaggtgcaccgcggcccggccaggcggagcgtcctcgccctgacccacgagggcaggttccacccgggcctggggtacgagcagcgctaccacagtggggacgtgcgcctcgacaccgtgggcagcgacgcctaccgcctctcagtgtcccgggctctgtctgccgaccagggctcctacaggtgtatcgtcagcgagtggatcgccgagcagggcaactggcaggaaatccaagaaaaggccgtggaagttgccaccgtggtgatccagccatcagttctgcgagcagctgtgcccaagaatgtgtctgtggctgaaggaaaggaactggacctgacctgtaacatcacaacagaccgagccgatgacgtccggcccgaggtgacgtggtccttcagcaggatgcctgacagcaccctacctggctcccgcgtgttggcgcggcttgaccgtgattccctggtgcacagctcgcctcatgttgctttgagtcatgtggatgcacgctcctaccatttactggttcgggatgttagcaaagaaaactctggctactattactgccacgtgtccctgtgggcacccggacacaacaggagctggcacaaagtggcagaggccgtgtcttccccagctggtgtgggtgtgacctggctagaaccagactaccaggtgtacctgaatgcttccaaggtccccgggtttgcggatgaccccacagagctggcatgccgggtggtggacacgaagagtggggaggcgaatgtccgattcacggtttcgtggtactacaggatgaaccggcgcagcgacaatgtggtgaccagcgagctgcttgcagtcatggacggggactggacgctaaaatatggagagaggagcaagcagcgggcccaggatggagactttattttttctaaggaacatacagacacgttcaatttccggatccaaaggactacagaggaagacagaggcaattattactgtgttgtgtctgcctggaccaaacagcggaacaacagctgggtgaaaagcaaggatgtcttctccaagcctgttaacatattttgggcattagaagattccgtgcttgtggtgaaggcgaggcagccaaagcctttctttgctgccggaaatacatttgagatgacttgcaaagtatcttccaagaatattaagtcgccacgctactctgttctcatcatggctgagaagcctgtcggcgacctctccagtcccaatgaaacgaagtacatcatctctctggaccaggattctgtggtgaagctggagaattggacagatgcatcacgggtggatggcgttgttttagaaaaagtgcaggaggatgagttccgctatcgaatgtaccagactcaggtctcagacgcagggctgtaccgctgcatggtgacagcctggtctcctgtcaggggcagcctttggcgagaagcagcaaccagtctctccaatcctattgagatagacttccaaacctcaggtcctatatttaatgcttctgtgcattcagacacaccatcagtaattcggggagatctgatcaaattgttctgtatcatcactgtcgagggagcagcactggatccagatgacatggcctttgatgtgtcctggtttgcggtgcactcttttggcctggacaaggctcctgtgctcctgtcttccctggatcggaagggcatcgtgaccacctcccggagggactggaagagcgacctcagcctggagcgcgtgagtgtgctggaattcttgctgcaagtgcatggctccgaggaccaggactttggcaactactactgttccgtgactccatgggtgaagtcaccaacaggttcctggcagaaggaggcagagatccactccaagcccgtttttataactgtgaagatggatgtgctgaacgccttcaagtatcccttgctgatcggcgtcggtctgtccacggtcatcgggctcctgtcctgtctcatcgggtactgcagctcccactggtgttgtaagaaggaggttcaggagacacggcgcgagcgccgcaggctcatgtcgatggagatggactag

SEQ ID NO: 8476 - DNA, 814 bp, synthetic construct
  misc_feature 1..814: note = Synthetic polypeptide
  source 1..814: mol_type = other DNA
ctccttccacggtctccctctgatgccgagccaaagctggacggtactgctgccatctcggctcactgcaacctccctgcctgattctcctgcctcagcctgccgagtgcctgcgcacgccgccacgcctgactggttttcgttttttttttttggtggagacggggttttgctgtgttggccgggctggtctccagctcctgaccgcgagtgatccgccggcctcggcctcccgaggtgccgggattgcggacggagtctcgttcactcggtgctcggtggtgcccaggctggagtgcagtggcgtgatctcggctcgctacaacctccacctcccagccgcctgccttggccccccaaagtgccgagattgcagcctctgcccggccgccaccccgtctgggaagtgaggagcgtctctgcctggccccccatcgtctgggatatgaggagcctctctgcctggctgcccagtctggagggtgaggagcgtctctgcccggccgccatcccatctaggaggcgaggagcgcctcttccccgccgccatcccatctaggaagtgaggagcgtctctgcccggccgcccatcgtctgagatgtggggagcacctctgccccgccgccctgtctgggatgtgaggagcgcctctgctgggccgcaaccctgtctgggagacatgtagactgccaaagtgtatgggatgctttcaagggtgcatttatttcaaaacatccttgcaacattactgaagaagactatcagccactaatgaagttgggaactcagaccgtaccttgcaacaagaaataa

SEQ ID NO: 8477 - DNA, 1348 bp, synthetic construct
  misc_feature 1..1348: note = Synthetic polypeptide
  source 1..1348: mol_type = other DNA
ctccttccacggtctccctctgatgccgagccaaagctggacggtactgctgccatctcggctcactgcaacctccctgcctgattctcctgcctcagcctgccgagtgcctgcgcacgccgccacgcctgactggttttcgttttttttttttggtggagacggggttttgctgtgttggccgggctggtctccagctcctgaccgcgagtgatccgccggcctcggcctcccgaggtgccgggattgcggacggagtctcgttcactcggtgctcggtggtgcccaggctggagtgcagtggcgtgatctcggctcgctacaacctccacctcccagccgcctgccttggccccccaaagtgccgagattgcagcctctgcccggccgccaccccgtctgggaagtgaggagcgtctctgcctggccccccatcgtctgggatatgaggagcctctctgcctggctgcccagtctggagggtgaggagcgtctctgcccggccgccatcccatctaggaggcgaggagcgcctcttccccgccgccatcccatctaggaagtgaggagcgtctctgcccggccgcccatcgtctgagatgtggggagcacctctgccccgccgccctgtctgggatgtgaggagcgcctctgctgggccgcaaccctgtctgggagacatgtagactgccaaagtgtatgggatgctttcaagggtgcatttatttcaaaacatccttgcaacattactgaagaagactatcagccactaatgaagttgggaactcagaccgtaccttgcaacaagattcttctttggagcagaataaaagatctggcccatcagttcacacaggtccagcgggacatgttcaccctggaggacacgctgctaggctaccttgctgatgacctcacatggtgtggtgaattcaacacttccaaaataaactatcaatcttgcccagactggagaaaggactgcagcaacaaccctgtttcagtattctggaaaacggtttcccgcaggtttgcagaagctgcctgtgatgtggtccatgtgatgctcaatggatcccgcagtaaaatctttgacaaaaacagcacttttgggagtgtggaagtccataatttgcaaccagagaaggttcagacactagaggcctgggtgatacatggtggaagagaagattccagagacttatgccaggatcccaccataaaagagctggaatcgattataagcaaaaggaatattcaattttcctgcaagaatatctacagacctgacaagtttcttcagtgtgtgaaaaatcctgaggattcatcttgcacatctgagatctga

SEQ ID NO: 8478 - DNA, 658 bp, synthetic construct; identical to SEQ ID NO: 7189
  misc_feature 1..658: note = Synthetic polypeptide
  source 1..658: mol_type = other DNA

SEQ ID NO: 8479 - DNA, 1999 bp, synthetic construct; identical to SEQ ID NO: 7190
  misc_feature 1..1999: note = Synthetic polypeptide
  source 1..1999: mol_type = other DNA

SEQ ID NO: 8480 - DNA, 671 bp, synthetic construct; identical to SEQ ID NO: 7191
  misc_feature 1..671: note = Synthetic polypeptide
  source 1..671: mol_type = other DNA

SEQ ID NO: 8481 - DNA, 739 bp, synthetic construct; identical to SEQ ID NO: 7192
  misc_feature 1..739: note = Synthetic polypeptide
  source 1..739: mol_type = other DNA

SEQ ID NO: 8482 - DNA, 1392 bp, synthetic construct; identical to SEQ ID NO: 6782
  misc_feature 1..1392: note = Synthetic polypeptide
  source 1..1392: mol_type = other DNA

SEQ ID NO: 8483 - DNA, 933 bp, synthetic construct; identical to SEQ ID NO: 6783
  misc_feature 1..933: note = Synthetic polypeptide
  source 1..933: mol_type = other DNA

SEQ ID NO: 8484 - DNA, 981 bp, synthetic construct; identical to SEQ ID NO: 6784
  misc_feature 1..981: note = Synthetic polypeptide
  source 1..981: mol_type = other DNA

SEQ ID NO: 8485 - DNA, 2157 bp, synthetic construct
  misc_feature 1..2157: note = Synthetic polypeptide
  source 1..2157: mol_type = other DNA
ctctccctctccccctccccctccccctctccctctccccacggtctccctctccctctctttccagggtctccctctgatgcccagccgaagctggactgtactgctgccatctcggctcactgcaacctccccgcctgattctcctgcctcagcctgcagagtgcctgccattgcaggcacgcgccgccacgcctgactggttttcgtatttttttggtggagatggggtttcgctgtgttggccgggctagtctccagctcctaaccgcgagtgatccgccagcctcggcctccggaggtgccgggattgcagacggtgtctggttcaatcagtgctcaatggtgcccaggctggaatgcagtggcgtgatctcggctcgctacaacctccacctcccagccacctgccttggcctcccaaagtgccgagagtgcagcctctgcccggccgccaccccgtctgggaagtgaggagcgtctctgcctggccgcctatcgtctgggacgtgaggagcccctctgcgtggctgcccagtctggaaagtgaggagcgtctctgcccggtcgccatcccatctaggaagtgaggagcgcctcttcccggccgccatcccatctaggaagtgaggagcatctctgcctggccgcccttcttctgagatgtggggagcgcctttgccccaccgccctgtctgggatgtgaggagcgcctctgccaggccgcgaccccgtctgggaggtgaggagcgtctctgcccagccgccccgtctgagaagggaggagaccctccgcccggcaaccgccccgtctcagaagtgaggagcccttccacccggcagtcaccccgtctgggacgtgaggagcgtctccgccaggcagccaccccgtccgggagggaggtgggggtcagcccccaccaggccagccgccccgtccgggagggaggtggggggggatcagccccctgcccggccagccgccccgtccgggaggaaggtgggggggccagccccccgcccggctagccgccccgtctgggaggaaccagtagatcctctaaaggaagaagccttattggtaaggttgatggcacatcccacgtcactggaaaaggagttacagttgaaacagtcttttctgtggatgagttttctgcatctgtcctcactggaaaactgaccactgtcttccttccaattgtctacacaattgtgtttgtggtgggtttgccaagtaacggcatggccctgtgggtctttcttttccgaactaagaagaagcaccctgctgtgatttacatggccaatctggccttggctgacctcctctctgtcatctggttccccttgaagattgcctatcacatacatggcaacaactggatttatggggaagctctttgtaatgtgcttattggctttttctatggcaacatgtactgttccattctcttcatgacctgcctcagtgtgcagaggtattgggtcatcgtgaaccccatggggcactccaggaagaaggcaaacattgccattggcatctccctggcaatatggctgctgattctgctggtcaccattcctttgtatgtcgtgaagcagaccatcttcattcctgccctgaacatcacgacctgtcatgatgttttgcctgagcagctcttggtgggagacatgttcaattacttcctctctctggccattggggtctttctgttcccagccttcctcacagcctctgcctatgtgctgatgatcagaatgctgcgatcttctgccatggatgaaaactcagagaagaaaaggaagagggccatcaaactcattgtcactgtcctggccatgtacctgatctgcttcactcctagtaaccttctgcttgtggtgcattattttctgattaagagccagggccagagccatgtctatgccctgtacattgtagccctctgcctctctacccttaacagctgcatcgacccctttgtctattactttgtttcacatgatttcagggatcatgcaaagaacgctctcctttgccgaagtgtccgcactgtaaagcagatgcaagtatccctcacctcaaagaaacactccaggaaatccagctcttactcttcaagttcaaccactgttaagacctcctattga

SEQ ID NO: 8486 - DNA, 2397 bp, synthetic construct
  misc_feature 1..2397: note = Synthetic polypeptide
  source 1..2397: mol_type = other DNA
ggccgagtgcggtggctcatgcctgtaatcccagcactttgggaggccgagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtag

SEQ ID NO: 8487 - DNA, 2412 bp, synthetic construct
  misc_feature 1..2412: note = Synthetic polypeptide
  source 1..2412: mol_type = other DNA
ggccgagtgcggtggctcatgcctgtaatcccagcactttgggaggccgagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacccctgctcccccagcggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtag

SEQ ID NO: 8488 - DNA, 55 bp, synthetic construct
  misc_feature 1..55: note = Synthetic polypeptide
  source 1..55: mol_type = other DNA
ggccgagtgcggtggctcatgcctgtaatcccagcactttgggaggccgagataa

SEQ ID NO: 8489 - DNA, 2328 bp, synthetic construct
  misc_feature 1..2328: note = Synthetic polypeptide
  source 1..2328: mol_type = other DNA
ggccgagtgcggtggctcatgcctgtaatcccagcactttgggaggccgagataaatttccgctgtaagccgtccttccgtgaatcaggctccaggaatgtccgcgagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtag

SEQ ID NO: 8490 - DNA, 249 bp, synthetic construct
  misc_feature 1..249: note = Synthetic polypeptide
  source 1..249: mol_type = other DNA
ggccgagtgcggtggctcatgcctgtaatcccagcactttgggaggccgagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggca

SEQ ID NO: 8491 - DNA, 1512 bp, synthetic construct
  misc_feature 1..1512: note = Synthetic polypeptide
  source 1..1512: mol_type = other DNA
tatggtaggctgaataatggtcccctcccatcccaagatgtccatatcctaaccgcccctctttgcctgtgagtttccttacacagcaacagggaccttgccatgtaaatcaaagatcttaagttggggagattatgctcattgtctgggtaaatctaatgtcatcaaaggatccttataagaaggaggcagaagggtcagagaaaggagatgtgaggataatggaagcagaagtcaggagagagggaacagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatctctgagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggtagcagtggaagctactactccagcagcagtgggggtgtcggcctaggtggtgggctcagtgtggggggctctggcttcagtgcaagcagtggccgagggctgggggtgggctttggcagtggcgggggtagcagctccagcgtcaaatttgtctccaccacctcctcctcccggaagagcttcaagagctaa

SEQ ID NO: 8492 - DNA, 605 bp, synthetic construct
  misc_feature 1..605: note = Synthetic polypeptide
  source 1..605: mol_type = other DNA
tatggtaggctgaataatggtcccctcccatcccaagatgtccatatcctaaccgcccctctttgcctgtgagtttccttacacagcaacagggaccttgccatgtaaatcaaagatcttaagttggggagattatgctcattgtctgggtaaatctaatgtcatcaaaggatccttataagaaggaggcagaagggtcagagaaaggagatgtgaggataatggaagcagaagtcaggagagagggaacagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagct

SEQ ID NO: 8493 - DNA, 285 bp, synthetic construct
  misc_feature 1..285: note = Synthetic polypeptide
  source 1..285: mol_type = other DNA
tatggtaggctgaataatggtcccctcccatcccaagatgtccatatcctaaccgcccctctttgcctgtgagtttccttacacagcaacagggaccttgccatgtaaatcaaagatcttaagttggggagattatgctcattgtctgggtaaatctaatgtcatcaaaggatccttataagaaggaggcagaagggtcagagaaaggagatgtgaggataatggaagcagaagtcaggagagagggaacagatcaagaccctcaacaataagtttgcctccttc

SEQ ID NO: 8494 - DNA, 223 bp, synthetic construct
  misc_feature 1..223: note = Synthetic polypeptide
  source 1..223: mol_type = other DNA
agtcagcgacagagctggggcccgcgtctcctgactctgcactgacttctcacatggcctcatgcgaacgccttcagctccctcggcctccgcttcctctgtgatgtggggatgatgacaattcccaccacaaaagtctatcaaaaggaaacttcctttcctcaactgggatgcctttcctaagctgaaaggactgaggagcgcaactcctgatgcccagtga

SEQ ID NO: 8495 - DNA, 1584 bp, synthetic construct
  misc_feature 1..1584: note = Synthetic polypeptide
  source 1..1584: mol_type = other DNA
cagaggtccccaacccccaggccataaaccagtacccttctgtggcctcttaggaacctggactcacagcaagaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaa

SEQ ID NO: 8496 - DNA, 1242 bp, synthetic construct
  misc_feature 1..1242: note = Synthetic polypeptide
  source 1..1242: mol_type = other DNA
cagaggtccccaacccccaggccataaaccagtacccttctgtggcctcttaggaacctggactcacagcaagaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagcgtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaa

SEQ ID NO: 8497 - DNA, 1539 bp, synthetic construct
  misc_feature 1..1539: note = Synthetic polypeptide
  source 1..1539: mol_type = other DNA
cagaggtccccaacccccaggccataaaccagtacccttctgtggcctcttaggaacctggactcacagcaagaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaa

SEQ ID NO: 8498 - DNA, 1623 bp, synthetic construct
  misc_feature 1..1623: note = Synthetic polypeptide
  source 1..1623: mol_type = other DNA
cagaggtccccaacccccaggccataaaccagtacccttctgtggcctcttaggaacctggactcacagcaagaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacagaaaaccagtctatccaagaccaggcacctatgttggaaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaa

SEQ ID NO: 8499 - DNA, 1677 bp, synthetic construct
  misc_feature 1..1677: note = Synthetic polypeptide
  source 1..1677: mol_type = other DNA
cagaggtccccaacccccaggccataaaccagtacccttctgtggcctcttaggaacctggactcacagcaagaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatgttagaattgcccctactgtcactacctggagtaacaaaactcctactgcccttcccagccatccacctgcagcctctccctctgacacacagggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaa

SEQ ID NO: 8500 - DNA, 1632 bp, synthetic construct
  misc_feature 1..1632: note = Synthetic polypeptide
  source 1..1632: mol_type = other DNA
cagaggtccccaacccccaggccataaaccagtacccttctgtggcctcttaggaacctggactcacagcaagaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatgttagaattgcccctactgtcactacctggagtaacaaaactcctactgcccttcccagccatccacctgcagcctctccctctgacacacagggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaa

SEQ ID NO: 8501 - DNA, 555 bp, synthetic construct
  misc_feature 1..555: note = Synthetic polypeptide
  source 1..555: mol_type = other DNA
cagaggtccccaacccccaggccataaaccagtacccttctgtggcctcttaggaacctggactcacagcaagaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagcgtaagtag

SEQ ID NO: 8502 - DNA, 401 bp, synthetic construct
  misc_feature 1..401: note = Synthetic polypeptide
  source 1..401: mol_type = other DNA
cagaggtccccaacccccaggccataaaccagtacccttctgtggcctcttaggaacctggactcacagcaagaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttca

SEQ ID NO: 8503 - DNA, 166 bp, synthetic construct
  misc_feature 1..166: note = Synthetic polypeptide
  source 1..166: mol_type = other DNA
cagaggtccccaacccccaggccataaaccagtacccttctgtggcctcttaggaacctggactcacagcaagaggatctgattgagaaagttgtcatcctgcgaaaagctgtgcaactcactcaagccatggacactagtactgtaggagttctcttggctgcga

SEQ ID NO: 8504 - DNA, 701 bp, synthetic construct; identical to SEQ ID NO: 658
  misc_feature 1..701: note = Synthetic polypeptide
  source 1..701: mol_type = other DNA

SEQ ID NO: 8505 - DNA, 809 bp, synthetic construct
  misc_feature 1..809: note = Synthetic polypeptide
  source 1..809: mol_type = other DNA
cctggttctctggggcacgaggcttctcctcagcactctggcgcccccaacaggttcccagtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 8506 - DNA, 809 bp, synthetic construct
  misc_feature 1..809: note = Synthetic polypeptide
  source 1..809: mol_type = other DNA
cctggttctctggggcacgaggcttctcctcagcactctggcgcccccaacaggttcccagtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagatgggatgatgcagaaacctggtagcaatgcacctgtgggaggaaatgttaccagcaatttctctggagatgacctagaatgcagaggaatagcctcctctcccaaaagccaacaagaaattaatgctgatataaaatgtcaagtagtgaaggaaatccgatgccttggacgaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga
